US011155803B2

(12) United States Patent
Gaudelli et al.

(10) Patent No.: US 11,155,803 B2
(45) Date of Patent: *Oct. 26, 2021

(54) ADENOSINE DEAMINASE BASE EDITORS AND METHODS OF USING SAME TO MODIFY A NUCLEOBASE IN A TARGET SEQUENCE

(71) Applicant: Beam Therapeutics Inc., Cambridge, MA (US)

(72) Inventors: Nicole Gaudelli, Cambridge, MA (US); Michael Packer, Cambridge, MA (US); Ian Slaymaker, Cambridge, MA (US); Yi Yu, Cambridge, MA (US); Bernd Zetsche, Cambridge, MA (US); Jason Michael Gehrke, Cambridge, MA (US); Natalie Petrossian, Cambridge, MA (US); Angelica Messana, Cambridge, MA (US); Yvonne Aratyn, Cambridge, MA (US); Francine Gregoire, Cambridge, MA (US); Genesis Lung, Cambridge, MA (US); Shaunna Berkovitch, Cambridge, MA (US); David A. Born, Cambridge, MA (US); Seung-Joo Lee, Cambridge, MA (US)

(73) Assignee: BEAM THERAPEUTICS INC., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/127,630

(22) Filed: Dec. 18, 2020

(65) Prior Publication Data

US 2021/0130805 A1 May 6, 2021

Related U.S. Application Data

(63) Continuation of application No. PCT/US2020/018192, filed on Feb. 13, 2020.

(60) Provisional application No. 62/805,238, filed on Feb. 13, 2019, provisional application No. 62/805,271, filed on Feb. 13, 2019, provisional application No. 62/805,277, filed on Feb. 13, 2019, provisional application No. 62/852,224, filed on May 23, 2019, provisional application No. 62/852,228, filed on May 23, 2019, provisional application No. 62/873,138, filed on Jul. 11, 2019, provisional application No. 62/873,140, filed on Jul. 11, 2019, provisional application No. 62/873,144, filed on Jul. 11, 2019, provisional application No. 62/876,354, filed on Jul. 19, 2019, provisional application No. 62/888,867, filed on Aug. 19, 2019, provisional application No. 62/912,992, filed on Oct. 9, 2019, provisional application No. 62/931,722, filed on Nov. 6, 2019, provisional application No. 62/931,747, filed on Nov. 6, 2019, provisional application No. 62/941,523, filed on Nov. 27, 2019, provisional application No. 62/941,569, filed on Nov. 27, 2019, provisional application No. 62/966,526, filed on Jan. 27, 2020.

(51) Int. Cl.
| | |
|---|---|
| C12N 9/78 | (2006.01) |
| C12N 9/22 | (2006.01) |
| C12N 15/11 | (2006.01) |
| A61P 43/00 | (2006.01) |

(52) U.S. Cl.
CPC ............... *C12N 9/78* (2013.01); *A61P 43/00* (2018.01); *C12N 9/22* (2013.01); *C12N 15/11* (2013.01); *C12Y 305/04004* (2013.01); *C07K 2319/09* (2013.01); *C07K 2319/80* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 10,113,163 B2 | 10/2018 | Liu et al. |
| 2015/0165054 A1 | 6/2015 | Liu et al. |
| 2016/0304846 A1 | 10/2016 | Liu et al. |
| 2019/0002875 A1 | 1/2019 | Cheng et al. |
| 2019/0093099 A1 | 3/2019 | Liu et al. |
| 2020/0308571 A1 | 10/2020 | Joung et al. |

FOREIGN PATENT DOCUMENTS

| | | |
|---|---|---|
| WO | 2017048969 A1 | 3/2017 |
| WO | 2018027078 A1 | 2/2018 |
| WO | 2018089664 A1 | 5/2018 |
| WO | 2018213726 A1 | 11/2018 |
| WO | 2020163396 A1 | 8/2020 |

OTHER PUBLICATIONS

Kim et al., "Structural and Kinetic Characterization of *Escherichia coli* TadA, the Wobble-Specific tRNA Deaminase", Biochemistry 2006, vol. 45, pp. 6407-6416. DOI: 10.1021/bi0522394.*

(Continued)

*Primary Examiner* — Suzanne M Noakes

(74) *Attorney, Agent, or Firm* — Greenberg Traurig, LLP; Melissa Hunter-Ensor; Nicholas Ballor

(57) ABSTRACT

The disclosure provides compositions comprising novel adenosine base editors (e.g., ABE8) that have increased efficiency and methods of using these adenosine deaminase variants for editing a target sequence.

30 Claims, 92 Drawing Sheets

Specification includes a Sequence Listing.

(56) References Cited

OTHER PUBLICATIONS

Gaudelli et al., "Programmable base editing of A-T to G-C in genomic DNA without DNA cleavage," Nature, Nov. 23, 2017, vol. 551, pp. 464-471.

International Search Report and Written Opinion issued in corresponding International Patent Application No. PCT/US2020/018192, dated Jun. 17, 2020 (14 pages).

Wolf J et al. "TadA, an essential tRNA-specific adenosine deaminase from *Escherichia coli*," The EMBO Journal, 2002, vol. 21, No. 14, pp. 3841-3851.

Lyons DM et al. "Efficient recogntion of an unpaired lesion by a DNA repair glycosylase," Dec. 16, 2009, JACS, vol. 131, pp. 17742-17743.

Lau AY et al. "Molecular basis for discriminating between normal and damaged bases by the human alkyladenine glycosylase, AAG," Dec. 5, 2000, PNAS, vol. 97. No. 25, pp. 13573-13578.

Zheng et al. "DNA editing in DNA/RNA hybrids by adenosine deaminases that act on RNA," Nucleic Acids Research, Jan. 28, 2017, vol. 45, pp. 3369-3377.

Komor et al. "Programmable editing of a target base in genomic DNA without double-stranded DNA cleavage," Oct. 20, 2016, vol. 533, pp. 420-424.

Yang et al. "Engineering and optimizing deaminase fusions for genome editing," Nature Communications, Nov. 2, 2016, vol. 7, pp. 13330.

Nishida, et al. "Targeted nucleotide editing using hybrid prokaryotic and vertebrate adaptive immune systems," 2016, Science, vol. 353, aaf8729.

\* cited by examiner

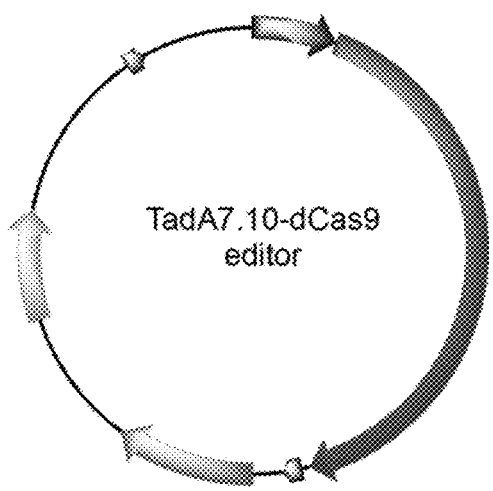
FIG. 1A
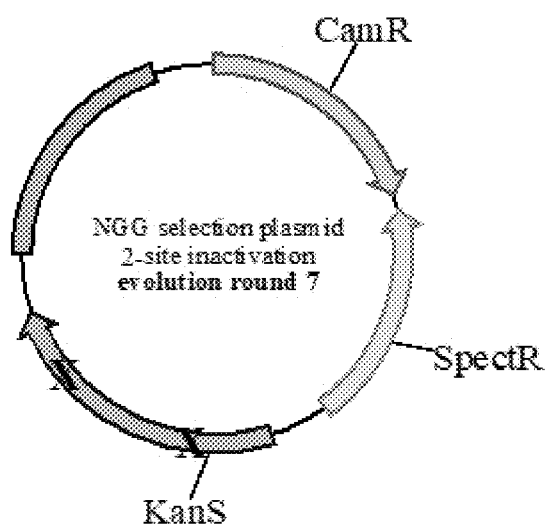 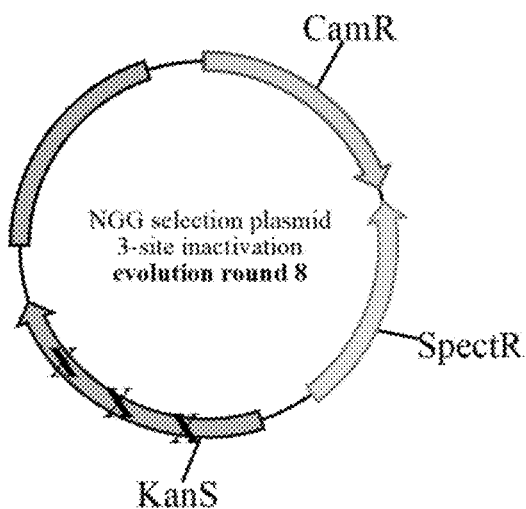
FIG. 1B                FIG. 1C

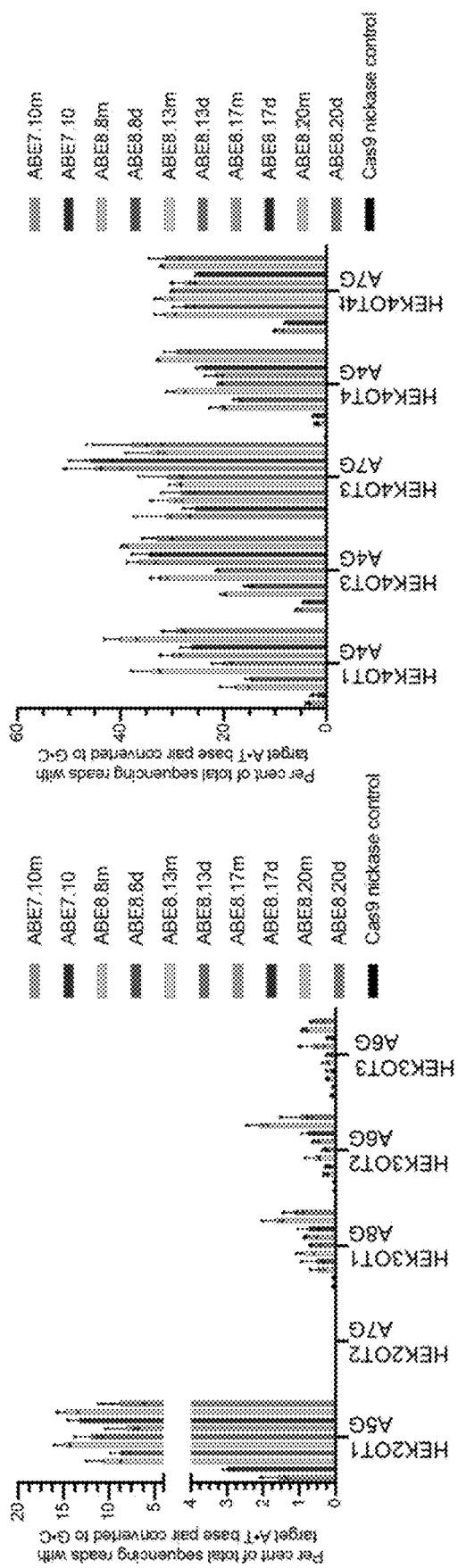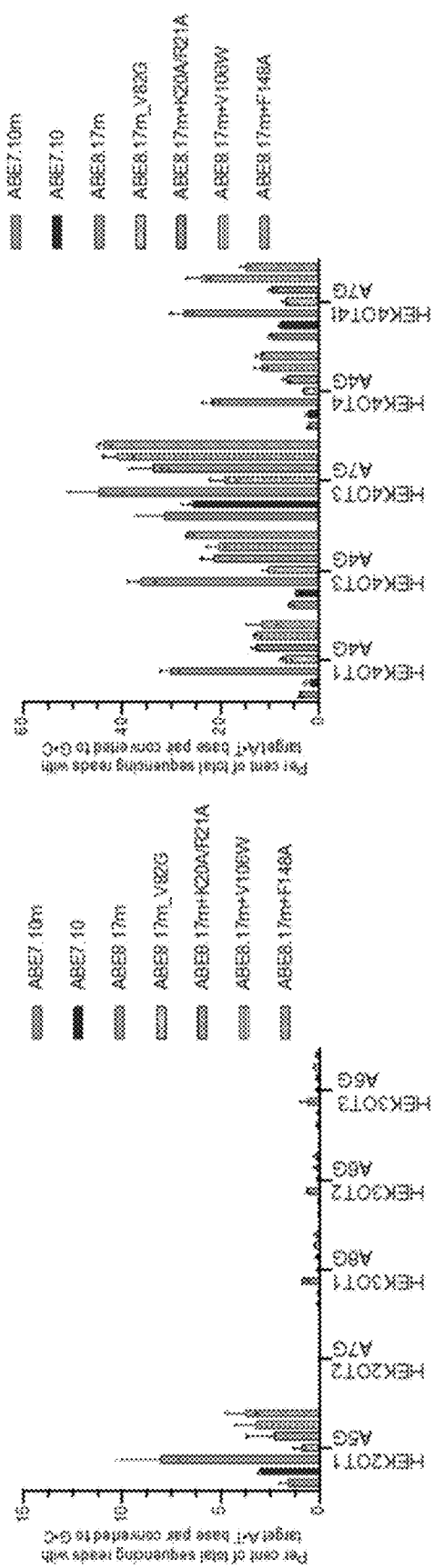
FIG. 25E FIG. 25F FIG. 25G FIG. 25H

ADENOSINE DEAMINASE BASE EDITORS AND METHODS OF USING SAME TO MODIFY A NUCLEOBASE IN A TARGET SEQUENCE

CROSS REFERENCE TO RELATED APPLICATIONS

This application is a U.S. National Stage filed under 35 U.S.C. § 111(a), which is a continuation of and claims priority to International Application No. PCT/US2020/018192, which claims priority to and benefit of U.S. Provisional Application Nos. 62/805,238 filed Feb. 13, 2019; 62/805,271, filed Feb. 13, 2019; 62/805,277 filed Feb. 13, 2019; 62/852,228, filed May 23, 2019; 62/852,224, filed May 23, 2019; 62/873,138 filed Jul. 11, 2019; 62/873,140 filed Jul. 11, 2019; 62/873,144 filed Jul. 11, 2019; 62/876,354, filed Jul. 19, 2019; 62/888,867 filed Aug. 19, 2019; 62/912,992, filed Oct. 9, 2019; 62/931,722, filed Nov. 6, 2019; 62/931,747 filed Nov. 6, 2019; 62/941,523 filed Nov. 27, 2019; 62/941,569, filed Nov. 27, 2019; and 62/966,526, filed Jan. 27, 2020, the contents of all of which are incorporated by reference herein in their entireties.

SEQUENCE LISTING

The instant application contains a Sequence Listing which has been submitted electronically in ASCII format and is hereby incorporated by reference in its entirety. Said ASCII copy, created on Dec. 16, 2020, is named 180802_042004USSL.txt and is 1,774,585 bytes in size.

INCORPORATION BY REFERENCE

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

BACKGROUND OF THE DISCLOSURE

Targeted editing of nucleic acid sequences, for example, the targeted cleavage or the targeted modification of genomic DNA is a highly promising approach for the study of gene function and also has the potential to provide new therapies for human genetic diseases. Currently available base editors include cytidine base editors (e.g., BE4) that convert target C•G base pairs to T•A and adenine base editors (e.g., ABE7.10) that convert A•T to G•C. There is a need in the art for improved base editors capable of inducing modifications within a target sequence with greater specificity and efficiency.

SUMMARY OF THE DISCLOSURE

The invention provides compositions comprising novel adenine base editors (e.g., ABE8) that have increased efficiency and methods of using base editors comprising adenosine deaminase variants for editing a target sequence.

In one aspect, the invention provides a fusion protein comprising a polynucleotide programmable DNA binding domain and at least one base editor domain that is an adenosine deaminase variant comprising an alteration at amino acid position 82 and/or 166 of MSEVEFSHEYWMRHALTLAKRARDEREVPVGAVLVLNNRVIGEGWNRA
IGLHDPTAHAEIMALRQGGLVMQNYRLIDATLYVTFEPCVMCAGAMIH
SRIGRVVFGVRNAKTGAAGSLMDVLHYPGMNHRVEITEGILADECAAL
LCYFFRMPRQVFNAQKKAQSST (SEQ ID NO: 4), or an alteration corresponding to positions 82 and/or 166 in a variant of MSEVEFSHEYWMRHALTLAKRARDEREVPVGAVLVLNNRVIGEGWNRA
IGLHDPTAHAEIMALRQGGLVMQNYRLIDATLYVTFEPCVMCAGAMIH
SRIGRVVFGVRNAKTGAAGSLMDVLHYPGMNHRVEITEGILADECAAL
LCYFFRMPRQVFNAQKKAQSST (SEQ ID NO: 4).

In some embodiments, the invention provides a fusion protein comprising a polynucleotide programmable DNA binding domain and at least one base editor domain that is an adenosine deaminase variant comprising an alteration at amino acid position 82 and/or 166 of MSEVEFSHEYWMRHALTLAKRARDEREVPVGAVLVLNNRVIGEGWNRA
IGLHDPTAHAEIMALRQGGLVMQNYRLIDATLYVTFEPCVMCAGAMIH
SRIGRVVFGVRNAKTGAAGSLMDVLHYPGMNHRVEITEGILADECAAL
LCYFFRMPRQVFNAQKKAQSTD (SEQ ID NO: 3), or of an amino acid sequence that is at least 50%, 55%, 60%, 65%, 70%, 75%, 80%, 85%, 90%, 95%, 96%, 97%, 98%, or 99% identical thereto. In some embodiments, the adenosine deaminase variant comprises an alteration at amino acid position 82 and/or 166 corresponding to MSEVEFSHEYWMRHALTLAKRARDEREVPVGAVLVLNNRVIGEGWNRA
IGLHDPTAHAEIMALRQGGLVMQNYRLIDATLYVTFEPCVMCAGAMIH
SRIGRVVFGVRNAKTGAAGSLMDVLHYPGMNHRVEITEGILADECAAL
LCYFFRMPRQVFNAQKKAQSTD (SEQ ID NO: 3)

in any of the following adenosine deaminases, or any variants thereto:

*Staphylococcus aureus* (*S. aureus*) TadA:
MGSHMTNDIYFMTLAIEEAKKAAQLGEVPIGAIITKDDEVIARAHNLR
ETLQQPTAHAEHIAIERAAKVLGSWRLEGCTLYVTLEPCVMCAGTIVM
SRIPRVVYGADDPKGGCSGSLMNLLQQSNFNHRAIVDKGVLKEACSTL
LTTFFKNLRANKKSTN (SEQ ID NO: 5)

*Bacillus subtilis* (*B. subtilis*) TadA:
MTQDELYMKEAIKEAKKAEEKGEVPIGAVLVINGEIIARAHNLRETEQ
RSIAHAEMLVIDEACKALGTWRLEGATLYVTLEPCPMCAGAVVLSRVE
KVVFGAFDPKGGCSGTLMNLLQEERFNHQAEVVSGVLEEECGGMLSAF
FRELRKKKKAARKNLSE (SEQ ID NO: 6)

-continued

Salmonella typhimurium (S. typhimurium) TadA:
MPPAFITGVTSLSDVELDHEYWMRHALTLAKRAWDEREVPVGAVLVHN

HRVIGEGWNRPIGRHDPTAHAEIMALRQGGLVLQNYRLLDTTLYVTLE

PCVMCAGAMVHSRIGRVVFGARDAKTGAAGSLIDVLHHPGMNHRVEII

EGVLRDECATLLSDFFRMRRQEIKALKKADRAEGAGPAV
(SEQ ID NO: 7)

Shewanella putrefaciens (S. putrefaciens) TadA:
MDEYWMQVAMQMAEKAEAAGEVPVGAVLVKDGQQIATGYNLSISQHDP

TAHAEILCLRSAGKKLENYRLLDATLYITLEPCAMCAGAMVHSRIARV

VYGARDEKTGAAGTVVNLLQHPAFNHQVEVTSGVLAEACSAQLSRFFK

RRRDEKKALKLAQRAQQGIE (SEQ ID NO: 8)

Haemophilus influenzae F3031 (H. influenzae)
TadA:
MDAAKVRSEFDEKMMRYALELADKAEALGEIPVGAVLVDDARNIIGEG

WNLSIVQSDPTAHAEIIALRNGAKNIQNYRLLNSTLYVTLEPCTMCAG

AILHSRIKRLVFGASDYKTGAIGSRFHFFDDYKMNHTLEITSGVLAEE

CSQKLSTFFQKRREEKKIEKALLKSLSDK (SEQ ID NO: 9)

Caulobacter crescentus (C. crescentus) TadA:
MRTDESEDQDHRMMRLALDAARAAAEAGETPVGAVILDPSTGEVIATA

GNGPIAAHDPTAHAEIAAMRAAAAKLGNYRLTDLTLVVTLEPCAMCAG

AISHARIGRVVFGADDPKGGAVVHGPKFFAQPTCHWRPEVTGGVLADE

SADLLRGFFRARRKAKI (SEQ ID NO: 10)

Geobacter sulfurreducens (G. sulfurreducens)
TadA:
MSSLKKTPIRDDAYWMGKAIREAAKAAARDEVPIGAVIVRDGAVIGRG

HNLREGSNDPSAHAEMIAIRQAARRSANWRLTGATLYVTLEPCLMCMG

AIILARLERVVFGCYDPKGGAAGSLYDLSADPRLNHQVRLSPGVCQEE

CGTMLSDFFRDLRRRKKAKATPALFIDERKVPPEP
(SEQ ID NO: 11)

In some embodiments, the polynucleotide programmable DNA binding domain comprises the following sequence:

EIGKATAKYFFYSNIMNFFKTEITLANGEIRKRPLIETNGETGEIVWD

KGRDFATVRKVLSMPQVNIVKKTEVQTGGFSKESILPKRNSDKLIARK

KDWDPKKYGGFMQPTVAYSVLVVAKVEKGKSKKLKSVKELLGITIMER

SSFEKNPIDFLEAKGYKEVKKDLIIKLPKYSLFELENGRKRMLASAKF

LQKGNELALPSKYVNFLYLASHYEKLKGSPEDNEQKQLFVEQHKHYLD

EIIEQISEFSKRVILADANLDKVLSAYNKHRDKPIREQAENIIHLFTL

TNLGAPRAFKYFDTTIARKEYRSTKEVLDATLIHQSITGLYETRIDLS

QLGGD*GGSGGSGGSGGSGGSGGSGGM*DKKYSIGLAIGTNSVGWAVITD

EYKVPSKKFKVLGNTDRHSIKKNLIGALLFDSGETAEATRLKRTARRR

YTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGH

FLIEGDLNPDNSDVDKLFIQLVQTYNQLFEENPINASGVDAKAILSAR

LSKSRRLENLIAQLPGEKKNGLFGNLIALSLGLTPNFKSNFDLAEDAK

LQLSKDTYDDDLDNLLAQIGDQYADLFLAAKNLSDAILLSDILRVNTE

ITKAPLSASMIKRYDEHHQDLTLLKALVRQQLPEKYKEIFFDQSKNGY

AGYIDGGASQEEFYKFIKPILEKMDGTEELLVKLNREDLLRKQRTFDN

GSIPHQIHLGELHAILRRQEDFYPFLKDNREKIEKILTFRIPYYVGPL

ARGNSRFAWMTRKSEETITPWNFEEVVDKGASAQSFIERMTNFDKNLP

NEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLK

IIKDKDFLDNEENEDILEDIVLTLTLFEDREMIEERLKTYAHLFDDKV

MKQLKRRRYTGWGRLSRKLINGIRDKQSGKTILDFLKSDGFANRNFMQ

LIHDDSLTFKEDIQKAQVSGQGDSLHEHIANLAGSPAIKKGILQTVKV

VDELVKVMGRHKPENIVIEMARENQTTQKGQKNSRERMKRIEEGIKEL

GSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLL

NAKLITQRKFDNLTKAERGGLSELDKAGFIKRQLVETRQITKHVAQIL

DSRMNTKYDENDKLIREVKVITLKSKLVSDFRKDFQFYKVREINNYHH

AHDAYLNAVVGTALIKKYPKLESEFVYGDYKVYDVRKMIAKSEQ*EGAD*

*KRTADGSEFESPKKKRKV** (SEQ ID NO: 12), wherein the bold sequence indicates sequence derived from Cas9, the italics sequence denotes a linker sequence, and the underlined sequence denotes a bipartite nuclear localization sequence.

In various embodiments of the above aspects, the adenosine deaminase variant comprises alterations at amino acid position 82 and 166. In various embodiments of the above aspects, the adenosine deaminase variant comprises a V82S alteration. In various embodiments of the above aspects, the adenosine deaminase variant comprises a T166R alteration. In various embodiments of the above aspects, the adenosine deaminase variant comprises V82S and T166R alterations. In various embodiments of the above aspects, the adenosine deaminase variant further comprises one or more of the following alterations: Y147T, Y147R, Q154S, Y123H, and Q154R. In another embodiment, the adenosine deaminase variant comprises a combination of the following alterations: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; or I76Y+V82S+Y123H+Y147R+Q154R. In various embodiments of the above aspects, the adenosine deaminase variant comprises a deletion of the C terminus beginning at a residue selected from the group consisting of 149, 150, 151, 152, 153, 154, 155, 156, and 157.

In some embodiments, the base editor domain comprises an adenosine deaminase variant monomer. In some embodiments, the base editor domain is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, or ABE8.24-m. In various embodiments, the base editor domain comprises an adenosine deaminase heterodimer comprising a wild-type adenosine deaminase domain and an adenosine deaminase variant. In some embodiments, the base editor domain is ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d. In various embodiments of the above aspects, the base editor comprises a heterodimer comprising a TadA7.10 domain and an adenosine deaminase variant domain. In some embodiments, the adenosine deaminase variant is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

In various embodiments, the adenosine deaminase variant comprises or consists essentially of the following sequence or a fragment thereof having adenosine deaminase activity.

MSEVEFSHEYWMRHALTLAKRARDEREVPVGAVLVLNNRVIGEGWNRA
IGLHDPTAHAEIMALRQGGLVMQNYRLIDATLYVTFEPCVMCAGAMIH
SRIGRVVFGVRNAKTGAAGSLMDVLHYPGMNHRVEITEGILADECAAL
LCTFFRMPRQVFNAQKKAQSSTD (SEQ ID NO: 13).

In another embodiment, the adenosine deaminase variant is missing 1, 2, 3, 4, 5, 6, 7, 8, 9, 10, 11, 12, 13, 14, 15, 6, 17, 18, 19, or 20 N-terminal amino acid residues relative to the full length adenosine deaminase. In another embodiment, the adenosine deaminase variant is missing 1, 2, 3, 4, 5, 6, 7, 8, 9, 10, 11, 12, 13, 14, 15, 6, 17, 18, 19, or 20 C-terminal amino acid residues relative to the full length adenosine deaminase. In some embodiments, the adenosine deaminase variant comprises Y147T+Q154R. In some embodiments, the adenosine deaminase variant comprises Y147T+Q154S. In some embodiments, the adenosine deaminase variant comprises Y147R+Q154S. In some embodiments, the adenosine deaminase variant comprises V82S+Q154S; V82S+Y147R. In some embodiments, the adenosine deaminase variant comprises V82S+Q154R. In some embodiments, the adenosine deaminase variant comprises V82S+Y123H. In some embodiments, the adenosine deaminase variant comprises I76Y+V82S. In some embodiments, the adenosine deaminase variant comprises V82S+Y123H+Y147T. In some embodiments, the adenosine deaminase variant comprises V82S+Y123H+Y147R. In some embodiments, the adenosine deaminase variant comprises V82S+Y123H+Q154R. In some embodiments, the adenosine deaminase variant comprises Y147R+Q154R+Y123H. In some embodiments, the adenosine deaminase variant comprises Y147R+Q154R+I76Y. In some embodiments, the adenosine deaminase variant comprises Y147R+Q154R+T166R. In some embodiments, the adenosine deaminase variant comprises Y123H+Y147R+Q154R+I76Y. In some embodiments, the adenosine deaminase variant comprises V82S+Y123H+Y147R+Q154R. In some embodiments, the adenosine deaminase variant comprises I76Y+V82S+Y123H+Y147R+Q154R.

In some embodiments, the polynucleotide programmable DNA binding domain is a Cas9. In some embodiments, the Cas9 polypeptide comprises the following amino acid sequence (Cas9 reference sequence):

MDKK<u>YSIGLDIGTNSVGWAVITDEYKVPSKKFKVLGNTDRHSIKKNLI
GALLFDSGETAE</u>ATRLKRTARRRYTRRKNRICYLQEIFSNEMAKVD
DSFFHRLEESFLVEEDKKHERHPIFGNIVDEVAYHEKYPTIYHLRKKL
VDSTDKADLRLIYLALAHMIKFRGHFLIEGDLNPDNSDVDKLFIQLVQ
TYNQLFEENPINASGVDAKAILSARLSKSRRLENLIAQLPGEKKNGLF
GNLIALSLGLTPNFKSNFDLAEDAKLQLSKDTYDDDLDNLLAQIGDQY
ADLFLAAKNLSDAILLSDILRVNTEITKAPLSASMIKRYDEHHQDLTL
LKALVRQQLPEKYKEIFFDQSKNGYAGYIDGGASQEEFYKFIKPILEK
MDGTEELLVKLNREDLLRKQRTFDNGSIPHQIHLGELHAILRRQEDFY
PFLKDNREKIEKILTFRIPYYVGPLARGNSRFAWMTRKSEETITPWNF
EEVVDKGASAQSFIERMTNFDKNLPNEKVLPKHSLLYEYFTVYNELTK
VKYVTEGMRKPAFLSGEQKKAIVDLLFKTNRKVTVKQLKEDYFKKIEC
FDSVEISGVEDRFNASLGTYHDLLKIIKDKDFLDNEENEDILEDIVLT
LTLFEDREMIEERLKTYAHLFDDKVMKQLKRRRYTGWGRLSRKLINGI
RDKQSGKTILDFLKSDGFANRNFMQLIHDDSLTFKEDIQKAQVSGQG<u>D
SLHEHIANLAGSPAIKKGILQTVKVVDELVKVMGRHKPENIVIEMARE
NQTTQKGQKNSRERMKRIEEGIKELGSQILKEHPVENTQLQNEKLYLY
YLQNGRDMYVDQELDINRLSDYDVDHIVPQSFLKDDSIDNKVLTRSDK
NRGKSDNVPSEEVVKKMKNYWRQLLNAKLITQRKFDNLTKAERG</u>GLSE
LDKAGFIKRQLVETRQITKHVAQILDSRMNTKYDENDKLIREVKVITL
KSKLVSDFRKDFQFYKVREINNYHHAHDAYLNAVVGTALIKKYPKLES
EFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQT
GGFSKESILPKRNSDKLIARKKDWDPKKYGGFDSPTVAYSVLVVAKVE
KGKSKKLKSVKELLGITIMERSSFEKNPIDFLEAKGYKEVKKDLIIKL
PKYSLFELENGRKRMLASAGELQKGNELALPSKYVNFLYLASHYEKLK
GSPEDNEQKQLFVEQHKHYLDEIIEQISEFSKRVILADANLDKVLSAY
NKHRDKPIREQAENIIHLFTLTNLGAPAAFKYFDTTIDRKRYTSTKEV
LDATLIHQSITGLYETRIDLSQLGGD (SEQ ID NO: 1)
(single underline: HNH domain; double underline:
RuvC domain; (Cas9 reference sequence), or a
corresponding region thereof.

In various embodiments, the polynucleotide programmable DNA binding domain is a *Staphylococcus aureus* Cas9 (SaCas9), *Streptococcus thermophilus* 1 Cas9 (St1Cas9), a *Streptococcus pyogenes* Cas9 (SpCas9), or variants thereof. In various embodiments, the polynucleotide programmable DNA binding domain comprises a variant of SpCas9 having an altered protospacer-adjacent motif (PAM) specificity or having specificity for a non-G PAM. In various embodiments of the above aspects, the altered PAM has specificity for the nucleic acid sequence 5'-NGC-3'. In various embodiments of the above aspects, the modified SpCas9 comprises amino acid substitutions D1135M, S1136Q, G1218K, E1219F, A1322R, D1332A, R1335E, and T1337R, or corresponding amino acid substitutions thereof. In various embodiments of the above aspects, the polynucleotide programmable DNA binding domain is a nuclease inactive or nickase variant. In various embodiments of the above aspects, the nickase variant comprises an amino acid substitution D10A or a corresponding amino acid substitution thereof. In various embodiments of the above aspects, the base editor further comprises a zinc finger domain. In various embodiments of the above aspects, the adenosine deaminase domain is capable of deaminating adenine in deoxyribonucleic acid (DNA).

In various embodiments, the adenosine deaminase variant is a TadA deaminase. In various embodiments of the above aspects, the TadA deaminase is TadA*7.10. In various embodiments, the TadA deaminase is a TadA*8 variant. adenosine deaminase variant is capable of deaminating adenine in deoxyribonucleic acid (DNA). In some embodiments, the adenosine deaminase variant is a *Staphylococcus aureus* TadA, a *Bacillus subtilis* TadA, a *Salmonella typhimurium* TadA, a *Shewanella putrefaciens* TadA, a *Haemophilus influenzae* F3031 TadA, a *Caulobacter crescentus* (*C. crescentus*) TadA, or a *Geobacter sulfurreducens* TadA, or a fragment thereof. In some embodiments, the adenosine deaminase variant is an adenosine deaminase that does not occur in nature.

In various embodiments of the above aspects, the fusion protein contains a linker between the polynucleotide programmable DNA binding domain and the adenosine deaminase domain. In various embodiments of the above aspects, the linker comprises the amino acid sequence: SGGSSGGSSGSETPGTSESATPES (SEQ ID NO: 14). In various embodiments of the above aspects, comprising one or more nuclear localization signals. In various embodiments of the above aspects, the nuclear localization signal is a bipartite nuclear localization signal.

In various embodiments of the above aspects, the Cas9 is a StCas9 or a SaCas9. In various embodiments of the above aspects, the Cas9 is a modified SaCas9. In various embodiments of the above aspects, the modified SaCas9 comprises amino acid substitutions E781K, N967K, and R1014H, or corresponding amino acid substitutions thereof. In various embodiments of the above aspects, the modified SaCas9 comprises the amino acid sequence:

KRNYILGLAIGITSVGYGIIDYETRDVIDAGVRLFKEANVENNEGRRS

KRGARRLKRRRRHRIQRVKKLLFDYNLLTDHSELSGINPYEARVKGLS

QKLSEEEFSAALLHLAKRRGVHNVNEVEEDTGNELSTKEQISRNSKAL

EEKYVAELQLERLKKDGEVRGSINRFKTSDYVKEAKQLLKVQKAYHQL

DQSFIDTYIDLLETRRTYYEGPGEGSPFGWKDIKEWYEMLMGHCTYFP

EELRSVKYAYNADLYNALNDLNNLVITRDENEKLEYYEKFQIIENVFK

QKKKPTLKQIAKEILVNEEDIKGYRVTSTGKPEFTNLKVYHDIKDITA

RKEIIENAELLDQIAKILTIYQSSEDIQEELTNLNSELTQEEIEQISN

LKGYTGTHNLSLKAINLILDELWHTNDNQIAIFNRLKLVPKKVDLSQQ

KEIPTTLVDDFILSPVVKRSFIQSIKVINAIIKKYGLPNDIIIELARE

KNSKDAQKMINEMQKRNRQTNERIEEIIRTTGKENAKYLIEKIKLHDM

QEGKCLYSLEAIPLEDLLNNPFNYEVDHIIPRSVSFDNSFNNKVLVKQ

EENSKKGNRTPFQYLSSSDSKISYETFKKHILNLAKGKGRISKIKKEY

LLEERDINRFSVQKDFINRNLVDTRYATRGLMNLLRSYFRVNNLDVKV

KSINGGFTSFLRRKWKFKKERNKGYKHHAEDALIIANADFIFKEWKKL

DKAKKVMENQMFEEKQAESMPEIETEQEYKEIFITPHQIKHIKDFKDY

KYSHRVDKKPNRKLINDTLYSTRKDDKGNTLIVNNLNGLYDKDNDKLK

KLINKSPEKLLMYHHDPQTYQKLKLIMEQYGDEKNPLYKYYEETGNYL

TKYSKKDNGPVIKKIKYYGNKLNAHLDITDDYPNSRNKVVKLSLKPYR

FDVYLDNGVYKFVTVKNLDVIKKENYYEVNSKCYEEAKKLKKISNQAE

FIASFYKNDLIKINGELYRVIGVNNDLLNRIEVNMIDITYREYLENMN

DKRPPHIIKTIASKTQSIKKYSTDILGNLYEVKSKKHPQIIKKG
(SEQ ID NO: 15).

A fusion protein comprising:
an adenosine deaminase variant domain, wherein the adenosine deaminase variant domain comprises the amino acid sequence of MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSST (SEQ ID NO: 4), wherein the amino acid sequence comprises at least one alteration, and a Cas9 or a Cas12 polypeptide, wherein the adenosine deaminase variant domain is inserted within the Cas9 or the Cas12 polypeptide.

In some embodiments, the adenosine deaminase variant domain is an adenosine deaminase monomer comprising a TadA*8 adenosine deaminase variant domain. In some embodiments, the adenosine deaminase variant domain is an adenosine deaminase heterodimer comprising a wild-type adenosine deaminase domain and a TadA*8 adenosine deaminase variant domain. In some embodiments, the adenosine deaminase variant domain is an adenosine deaminase heterodimer comprising a TadA domain and a TadA*8 adenosine deaminase variant domain. In some embodiments, the adenosine deaminase variant domain is inserted within a flexible loop, an alpha helix region, an unstructured portion, or a solvent accessible portion of the Cas9 or Cas12 polypeptide. In some embodiments, the flexible loop comprises a part of an alpha helix structure of the Cas9 or Cas12 polypeptide. In some embodiments, the adenosine deaminase variant domain is flanked by a N-terminal fragment and a C-terminal fragment of the Cas9 polypeptide. In some embodiments, the fusion protein comprises the structure: NH$_2$—[N-terminal fragment of a Cas9]-[adenosine deaminase variant]-[C-terminal fragment of a Cas9]-COOH, wherein each instance of "]-[" is an optional linker. In some embodiments, the N-terminal fragment or the C-terminal fragment of the Cas9 or Cas12 polypeptide binds a target polynucleotide sequence.

In some embodiments, the C-terminus of the N terminal fragment or the N-terminus of the C terminal fragment comprises a part of a flexible loop of the Cas9 or the Cas12 polypeptide. In some embodiments, the flexible loop comprises an amino acid in proximity to a target nucleobase when the fusion protein deaminates the target nucleobase. In some embodiments, the target nucleobase is 1-20 nucleobases away from a Protospacer Adjacent Motif (PAM) sequence in the target polynucleotide sequence. In some embodiments, the target nucleobase is 2-12 nucleobases upstream of the PAM sequence. In some embodiments, the N-terminal fragment or the C-terminal fragment comprises a RuvC domain; the N-terminal fragment or the C-terminal fragment comprises a HNH domain; neither the N-terminal fragment nor the C-terminal fragment comprises an HNH domain; or neither the N-terminal fragment nor the C-terminal fragment comprises a RuvC domain. In some embodiments, the Cas9 or Cas12 polypeptide comprises a partial or complete deletion in one or more structural domains and wherein the adenosine deaminase is inserted at the partial or complete deletion position of the Cas9 or Cas12 polypeptide. In some embodiments, the deletion is within a RuvC domain; the deletion is within an HNH domain; or the deletion bridges a RuvC domain and a C-terminal domain.

In some embodiments, the adenosine deaminase variant domain is inserted in a Cas12 polypeptide. In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or variants thereof. In some embodiments, the Cas9 comprises the following amino acid sequence (Cas9 reference sequence):

MDKK<u>YSIGLDIGTNSVGWAVITDEYKVPSKKFKVLGNTDRHSIKKNLI</u>

<u>GALLFDSGETAEATRLKRTARRRYTRRKNRICYLQEIFSNEMAKVD</u>

DSFFHRLEESFLVEEDKKHERHPIFGNIVDEVAYHEKYPTIYHLRKKL

VDSTDKADLRLIYLALAHMIKFRGHFLIEGDLNPDNSDVDKLFIQLVQ

TYNQLFEENPINASGVDAKAILSARLSKSRRLENLIAQLPGEKKNGLF

GNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTL

LKALVRQQLPEKYKEIFFDQSKNGYAGYIDGGASQEEFYKFIKPILEK

MDGTEELLVKLNREDLLRKQRTFDNGSIPHQIHLGELHAILRRQEDFY

PFLKDNREKIEKILTFRIPYYVGPLARGNSRFAWMTRKSEETITPWNF

EEVVDKGASAQSFIERMTNFDKNLPNEKVLPKHSLLYEYFTVYNELTK

VKYVTEGMRKPAFLSGEQKKAIVDLLFKTNRKVTVKQLKEDYFKKIEC

FDSVEISGVEDRFNASLGTYHDLLKIIKDKDFLDNEENEDILEDIVLT

LTLFEDREMIEERLKTYAHLFDDKVMKQLKRRRYTGWGRLSRKLINGI

RDKQSGKTILDFLKSDGFANRNFMQLIHDDSLTFKEDIQKAQVSGQG<u>D</u>

<u>SLHEHIANLAGSPAIKKGILQTVKVVDELVKVMGRHKPENIVIEMARE</u>

<u>NQTTQKG</u>QKNSRERMKRIEEGIKELGSQILKEHPVENTQLQNEKLYLY

YLQNGRDMYVDQELDINRLSDYDVDHIVPQSFLKDDSIDNKVLTRSDK

NRGKSDNVPSEEVVKKMKNYWRQLLNAKLITQRKFDNLTKAERG<u>GLSE</u>

<u>LDKAGFIKRQLVETRQITKHVAQILDSRMNTKYDENDKLIREVKVITL</u>

<u>KSKLVSDFRKDFQFYKVREINNYHHAHDAYLNAVVGTALIKKYPKLES</u>

<u>EFVYGDYKVYDVRKMIAKSEQEIGKATAKYFFYSNIMNFFKTEITLAN</u>

<u>GEIRKRPLIETNGETGEIVWDKGRDFATVRKVLSMPQVNIVKKTEVQT</u>

GGFSKESILPKRNSDKLIARKKDWDPKKYGGFDSPTVAYSVLVVAKVE

KGKSKKLKSVKELLGITIMERSSFEKNPIDFLEAKGYKEVKKDLIIKL

PKYSLFELENGRKRMLASAGELQKGNELALPSKYVNFLYLASHYEKLK

GSPEDNEQKQLFVEQHKHYLDEIIEQISEFSKRVILADANLDKVLSAY

NKHRDKPIREQAENIIHLFTLTNLGAPAAFKYFDTTIDRKRYTSTKEV

LDATLIHQSITGLYETRIDLSQLGGD (SEQ ID NO: 1)
(single underline: HNH domain; double underline: RuvC domain; ("Cas9 reference sequence"), or a corresponding region thereof.

In one aspect, the invention provides any of the fusion proteins provided herein, wherein: the Cas9 polypeptide comprises a deletion of amino acids 1017-1069 as numbered in the Cas9 polypeptide reference sequence or corresponding amino acids thereof; the Cas9 polypeptide comprises a deletion of amino acids 792-872 as numbered in the Cas9 polypeptide reference sequence or corresponding amino acids thereof; or the Cas9 polypeptide comprises a deletion of amino acids 792-906 as numbered in the Cas9 polypeptide reference sequence or corresponding amino acids thereof. In one embodiment, the adenosine deaminase variant domain is inserted within a flexible loop of the Cas9 polypeptide. In one embodiment, the flexible loop comprises a region selected from the group consisting of amino acid residues at positions 530-537, 569-579, 686-691, 768-793, 943-947, 1002-1040, 1052-1077, 1232-1248, and 1298-1300 as numbered in the Cas9 reference sequence, or corresponding amino acid positions thereof. In one embodiment, the adenosine deaminase variant domain is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the Cas9 reference sequence, or corresponding amino acid positions thereof. In one embodiment, the adenosine deaminase variant domain is inserted between amino acid positions 768-769, 792-793, 1022-1023, 1026-1027, 1040-1041, 1068-1069, or 1247-1248 as numbered in the Cas9 reference sequence or corresponding amino acid positions thereof. In one embodiment, the adenosine deaminase variant domain is inserted between amino acid positions 1016-1017, 1023-1024, 1029-1030, 1040-1041, 1069-1070, or 1247-1248 as numbered in the Cas9 reference sequence or corresponding amino acid positions thereof. In one embodiment, deaminase variant domain is inserted within the Cas9 polypeptide at the loci identified in Table 10A. In one embodiment, the N-terminal fragment comprises amino acid residues 1-529, 538-568, 580-685, 692-942, 948-1001, 1026-1051, 1078-1231, and/or 1248-1297 of the Cas9 reference sequence, or corresponding residues thereof. In one embodiment, the C-terminal fragment comprises amino acid residues 1301-1368, 1248-1297, 1078-1231, 1026-1051, 948-1001, 692-942, 580-685, and/or 538-568 of the Cas9 reference sequence, or corresponding residues thereof.

In some embodiments, the Cas9 polypeptide is a nickase or wherein the Cas9 polypeptide is nuclease inactive. In one embodiment, the Cas9 polypeptide is a modified SpCas9 polypeptide and has specificity for an altered PAM or specificity for a non-G PAM.

In one embodiment, the modified SpCas9 polypeptide, which includes amino acid substitutions D1135M, S1136Q, G1218K, E1219F, A1322R, D1332A, R1335E, and T1337R (SpCas9-MQKFRAER) and which has specificity for the altered PAM 5'-NGC-3'.

In one embodiment, the adenosine deaminase variant domain is inserted in a Cas12 polypeptide. In one embodiment, the Cas12 polypeptide is Cas12a, Cas12b, Cas12c, Cas12d, Cas12e, Cas12g, Cas12h, or Cas12i. In one embodiment, the Cas12 polypeptide has at least about 85% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In one embodiment, the Cas12 polypeptide comprises or consists essentially of a fragment of *Bacillus hisashii* Cas12b, *Bacillus thermoamylovorans* Cas12b, *Bacillus* sp. V3-13 Cas12b, or *Alicyclobacillus acidiphilus* Cas12b. In one embodiment, the adenosine deaminase variant domain is inserted between amino acid positions: a) 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, or Cas12i; b) 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, or Cas12i; or c) 157 and 158, 258 and 259, 310 and 311, 1008 and 1009, or 1044 and 1045 of AaCas12b or a corresponding amino acid residue of Cas12a, Cas12c, Cas12d, Cas12e, Cas12g, Cas12h, or Cas12i. In one embodiment, the adenosine deaminase variant domain is inserted at a loci identified in Table 10B.

In some embodiments, the Cas12 polypeptide is Cas12b. In one embodiment, the Cas12 polypeptide comprises a BhCas12b domain, a BvCas12b domain, or an AACas12b domain the Cas12b polypeptide comprises a mutation that silences the catalytic activity of a RuvC domain. In one embodiment, the Cas12b polypeptide comprises D574A, D829A and/or D952A mutations.

In one embodiment, the adenosine deaminase variant domain comprises a *Staphylococcus aureus* TadA, a *Bacillus subtilis* TadA, a *Salmonella typhimurium* TadA, a *Shewanella putrefaciens* TadA, a *Haemophilus influenzae* F3031 TadA, a *Caulobacter crescentus* (*C. crescentus*) TadA, or a *Geobacter sulfurreducens* TadA, or a variant or fragment thereof. In one embodiment, the adenosine deaminase is a non-naturally occurring adenosine deaminase.

In various embodiments, the fusion protein further comprises a cytidine deaminase.

In one aspect, the invention provides a fusion protein comprising the structure: NH$_2$-[TadA*8]-[Cas9]-[cytidine deaminase]-COOH, wherein each instance of "]-[" is an optional linker. In another aspect, the invention provides a fusion protein comprising the structure: NH$_2$-[cytidine deaminase]-[Cas9]-[TadA*8]-COOH, wherein each instance of "]-[" is an optional linker.

In one aspect, the invention provides a fusion protein comprising the structure: NH$_2$-[Cas9(TadA*8)]-[cytidine deaminase]-COOH, wherein each instance of "]-[" is an optional linker (e.g., TadA*8 internally fused within Cas9 and cytidine deaminase fused to the C-terminus). In one aspect, the invention provides a fusion protein comprising the structure: NH$_2$-[cytidine deaminase]-[Cas9(TadA*8)]-COOH, wherein each instance of "]-[" is an optional linker (e.g., TadA*8 internally fused within Cas9 and cytidine deaminase fused to the N-terminus). In another aspect, the invention provides a fusion protein comprising the structure: NH$_2$-[Cas9(cytidine deaminase)]-[TadA*8]-COOH, wherein each instance of "]-[" is an optional linker. In yet another aspect, the invention provides a fusion protein comprising the structure: NH$_2$-[TadA*8]-[Cas9(cytidine deaminase)]-COOH, wherein each instance of "]-[" is an optional linker.

In one aspect, the invention provides a fusion protein comprising the structure: NH$_2$-[Cas12(adenosine deaminase)]-[cytidine deaminase]-COOH, wherein each instance of "]-[" is an optional linker (e.g., an adenosine deaminase internally fused within Cas12 and cytidine deaminase fused to the C-terminus). In one aspect, the invention provides a fusion protein comprising the structure: NH$_2$-[cytidine deaminase]-[Cas12(adenosine deaminase)]-COOH, wherein each instance of "]-[" is an optional linker (e.g., adenosine deaminase internally fused within Cas12 and cytidine deaminase fused to the N-terminus). In another aspect, the invention provides a fusion protein comprising the structure: NH$_2$-[Cas12(cytidine deaminase)]-[adenosine deaminase]-COOH, wherein each instance of "]-[" is an optional linker. In yet another aspect, the invention provides a fusion protein comprising the structure: NH$_2$-[adenosine deaminase]-[Cas12(cytidine deaminase)]-C, wherein each instance of "]-[" is an optional linker.

In another aspect, the invention provides any of the fusion proteins provided herein in a complex with one or more guide nucleic acid sequences to effect deamination of a target nucleobase. In some embodiments, the fusion protein is further complexed with the target polynucleotide.

In one aspect, the invention provides a polynucleotide encoding any of the fusion proteins provided herein. In another aspect, the invention provides, an expression vector comprising any of the polynucleotides provided herein. In some embodiments, the expression vector is a mammalian expression vector. In some embodiments, the vector is a viral vector selected from the group consisting of adeno-associated virus (AAV), retroviral vector, adenoviral vector, lentiviral vector, Sendai virus vector, and herpesvirus vector. In some embodiments, the vector comprises a promoter.

In one aspect, the invention provides a cell comprising any of the fusion proteins provided herein. In one aspect, the invention provides a cell comprising any of the polynucleotides provided herein. In one aspect, the invention provides a cell comprising any of the vectors provided herein. In various embodiments, the cell is a bacterial cell, plant cell, insect cell, a human cell, or mammalian cell.

In one aspect, the invention provides a base editor comprising any of the fusion polypeptides provided herein in a complex with one or more guide polynucleotides. In one aspect, the invention provides a pharmaceutical composition comprising any of the fusion proteins provided herein, and a pharmaceutically acceptable excipient. In one aspect, the invention provides a pharmaceutical composition comprising any of the polynucleotides provided herein, and a pharmaceutically acceptable excipient. In one aspect, the invention provides a pharmaceutical composition comprising any of the vectors provided herein, and a pharmaceutically acceptable excipient. In one aspect, the invention provides a pharmaceutical composition comprising any of the cells provided herein, and a pharmaceutically acceptable excipient. In one aspect, the invention provides a pharmaceutical composition comprising any of the base editors provided herein, and a pharmaceutically acceptable excipient.

In one aspect, the invention provides a kit comprising any of the fusion proteins provided herein. In one aspect, the invention provides a kit comprising any of the polynucleotides provided herein. In one aspect, the invention provides a kit comprising any of the vectors provided herein. In one aspect, the invention provides a kit comprising any of the base editors provided herein.

In another aspect, the invention provides a method for base editing comprising contacting a polynucleotide sequence with any of the fusion proteins provided herein, wherein the adenosine deaminase variant domain of the fusion protein deaminates a nucleobase in the polynucleotide, thereby editing the polynucleotide sequence. In some embodiments, the methods further include contacting the target polynucleotide sequence with one or more guide polynucleotides to effect deamination of the target nucleobase.

In one aspect, the invention provides a method of editing a target polynucleotide, the method comprising contacting the target polynucleotide with the base editor of claim 116 to effect an A•T to G•C alteration in the target polynucleotide. In some embodiments, the methods further include contacting is in a cell, a eukaryotic cell, a mammalian cell, or human cell. In some embodiments, the cell is in vivo. In some embodiments, the cell is ex vivo.

In one aspect, the invention provides a method of treating a genetic defect in a subject, the method comprising administering to the subject a base editor comprising or consisting essentially of any of the fusion proteins provided herein, or a polynucleotide encoding said base editor and one or more guide polynucleotides that direct the base editor to deaminate a target nucleobase in a target nucleotide sequence of the subject, thereby treating the genetic defect.

In some embodiments, the guide polynucleotide comprises a nucleic acid sequence selected from the group consisting of: a) GACCUAGGCGAGGCAGUAGG (SEQ ID NO: 16); b) CCAGUAUGGACACUGUCCAAA (SEQ ID NO: 17); c) CAGUAUGGACACUGUCCAAA (SEQ ID NO: 18); and d) AGUAUGGACACUGUCCAAAG (SEQ ID NO: 19). In various embodiments, the gRNA further comprises a nucleic acid sequence GUUUUUGUACUCU-CAAGAUUUAAGUAACUGUACAACGAAACUUA-CACAGUUACUUAAAUCUU GCAGAAGCUA-CAAAGAUAAGGCUUCAUGCCGAAAUCAACACCCU-GUCAUUUUAUGGCAGGGU G (SEQ ID NO: 20). In various embodiments, the guide RNA comprises a CRISPR RNA (crRNA) and a trans-activating crRNA (tracrRNA).

In some embodiments, the methods further include delivering the base editor, or polynucleotide encoding said base editor, and one or more guide polynucleotides to a cell of the subject. In various embodiments, the subject is a mammal or a human. In various embodiments, the deamination of the target nucleobase replaces the target nucleobase with a wild type nucleobase. In various embodiments, the deamination of the target nucleobase replaces the target nucleobase with a non-wild type nucleobase, and wherein the deamination of the target nucleobase ameliorates symptoms of the genetic condition. In various embodiments, the target polynucleotide sequence comprises a mutation associated with the genetic condition at a nucleobase other than the target nucleobase.

The description and examples herein illustrate embodiments of the present disclosure in detail. It is to be understood that this disclosure is not limited to the particular embodiments described herein and as such can vary. Those of skill in the art will recognize that there are numerous variations and modifications of this disclosure, which are encompassed within its scope.

The practice of some embodiments disclosed herein employ, unless otherwise indicated, conventional techniques of immunology, biochemistry, chemistry, molecular biology, microbiology, cell biology, genomics and recombinant DNA, which are within the skill of the art. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)).

The section headings used herein are for organizational purposes only and are not to be construed as limiting the subject matter described.

Although various features of the present disclosure can be described in the context of a single embodiment, the features can also be provided separately or in any suitable combination. Conversely, although the present disclosure can be described herein in the context of separate embodiments for clarity, the present disclosure can also be implemented in a single embodiment. The section headings used herein are for organizational purposes only and are not to be construed as limiting the subject matter described.

The features of the present disclosure are set forth with particularity in the appended claims. A better understanding of the features and advantages of the present will be obtained by reference to the following detailed description that sets forth illustrative embodiments, in which the principles of the disclosure are utilized, and in view of the accompanying drawings as described hereinbelow.

Definitions

The following definitions supplement those in the art and are directed to the current application and are not to be imputed to any related or unrelated case, e.g., to any commonly owned patent or application. Although any methods and materials similar or equivalent to those described herein can be used in the practice for testing of the present disclosure, the preferred materials and methods are described herein. Accordingly, the terminology used herein is for the purpose of describing particular embodiments only, and is not intended to be limiting.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991).

In this application, the use of the singular includes the plural unless specifically stated otherwise. It must be noted that, as used in the specification, the singular forms "a," "an," and "the" include plural references unless the context clearly dictates otherwise. In this application, the use of "or" means "and/or," unless stated otherwise, and is understood to be inclusive. Furthermore, use of the term "including" as well as other forms, such as "include," "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, such as within 5-fold or within 2-fold, of a value. Where particular values are described in the application and claims, unless otherwise stated the term "about" meaning within an acceptable error range for the particular value should be assumed.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

By "abasic base editor" is meant an agent capable of excising a nucleobase and inserting a DNA nucleobase (A, T, C, or G). Abasic base editors comprise a nucleic acid glycosylase polypeptide or fragment thereof. In one embodiment, the nucleic acid glycosylase is a mutant human uracil DNA glycosylase comprising an Asp at amino acid 204 (e.g., replacing an Asn at amino acid 204) in the following sequence, or corresponding position in a uracil DNA glycosylase, and having cytosine-DNA glycosylase activity, or active fragment thereof. In one embodiment, the nucleic acid glycosylase is a mutant human uracil DNA glycosylase comprising an Ala, Gly, Cys, or Ser at amino acid 147 (e.g., replacing a Tyr at amino acid 147) in the following sequence, or corresponding position in a uracil DNA glycosylase, and having thymine-DNA glycosylase activity, or an active fragment thereof. The sequence of exemplary human uracil-DNA glycosylase, isoform 1, follows:

other abasic editor or uracil deglycosylase known in the art. In one embodiment, the abasic editor comprises a mutation at Y147, N204, L272, and/or R276, or corresponding position. In another embodiment, the abasic editor comprises a Y147A or Y147G mutation, or corresponding mutation. In another embodiment, the abasic editor comprises a N204D mutation, or corresponding mutation. In another embodiment, the abasic editor comprises a L272A mutation, or corresponding mutation. In another embodiment, the abasic editor comprises a R276E or R276C mutation, or corresponding mutation.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g., engineered adenosine deaminases, evolved adenosine deaminases) provided herein may be from any organism, such as a bacterium.

In some embodiments, the adenosine deaminase is a TadA deaminase. In some embodiments, the TadA deaminase is TadA variant. In some embodiments, the TadA variant is a TadA*8. In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%,

```
  1  mgvfclgpwg lgrklrtpgk gplqllsrlc gdhlqaipak kapagqeepg tppssplsae 61  qldriqrnka aallrlaarn vpvgfgeswk khlsgefgkp yfiklmgfva eerkhytvyp 121  pphqvftwtq mcdikdvkvv ilgqdpyhgp nqahglcfsv qrpvppppsl eniykelstd 181  iedfvhpghg dlsgwakqgv lllnavltvr ahqanshker gweqftdavv swlnqnsngl 241  vfllwgsyaq kkgsaidrkr hhvlqtahps plsvyrgffg crhfsktnel lqksgkkpid 301  wkel (SEQ ID NO: 21)
```

The sequence of human uracil-DNA glycosylase, isoform 2, follows:

at least 94%, at least 95%, at least 96%, at least 97%, at least 98%, at least 99%, at least 99.1%, at least 99.2%, at least

```
  1  migqktlysf fspsparkrh apspepavqg tgvagvpees gdaaaipakk apagqeepgt 61  ppssplsaeq ldriqrnkaa allrlaarnv pvgfgeswkk hlsgefgkpy fiklmgfvae 121  erkhytvypp phqvftwtqm cdikdvkvvi lgqdpyhgpn qahglcfsvq rpvppppsle 181  niykelstdi edfvhpghgd lsgwakqgvl llnavltvra hqanshkerg weqftdavvs 241  wlnqnsnglv fllwgsyaqk kgsaidrkrh hvlqtahpsp lsvyrgffgc rhfsktnell 301  qksgkkpidw kel (SEQ ID NO: 22)
```

In other embodiments, the abasic editor is any one of the abasic editors described in PCT/JP2015/080958 and US20170321210, which are incorporated herein by reference. In particular embodiments, the abasic editor comprises a mutation at a position shown in the sequence above in bold with underlining or at a corresponding amino acid in any 99.3%, at least 99.4%, at least 99.5%, at least 99.6%, at least 99.7%, at least 99.8%, or at least 99.9% identical to a naturally occurring deaminase. For example, deaminase domains are described in International PCT Application Nos. PCT/2017/045381 (WO 2018/027078) and PCT/US2016/058344 (WO 2017/070632), each of which is incorporated herein by reference for its entirety. Also, see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017)), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

A wild type TadA(wt) adenosine deaminase has the following sequence (also termed TadA reference sequence; SEQ ID NO: 2):

MSEVEFSHEYWMRHALTLAKRAWDEREVPVGAVLVHNNRVIGEGWNRP

IGRHDPTAHAEIMALRQGGLVMQNYRLIDATLYVTLEPCVMCAGAMIH

SRIGRVVFGARDAKTGAAGSLMDVLHHPGMNHRVEITEGILADECAAL

LSDFFRMRRQEIKAQKKAQSSTD.

In some embodiments, the adenosine deaminase comprises an alteration in the following sequence:

```
MSEVEFSHEY WMRHALTLAK RARDEREVPV GAVLVLNNRV

IGEGWNRAIG LHDPTAHAEI MALRQGGLVM QNYRLIDATL

YVTFEPCVMC AGAMIHSRIG RVVFGVRNAK TGAAGSLMDV

LHYPGMNHRV EITEGILADE CAALLCYFFR MPRQVFNAQK

KAQSSTD (SEQ ID NO: 25)
(also termed TadA*7.10).
```

In some embodiments, TadA*7.10 comprises at least one alteration. In some embodiments, TadA*7.10 comprises an alteration at amino acid 82 and/or 166. In particular embodiments, a variant of the above-referenced sequence comprises one or more of the following alterations: Y147T, Y147R, Q154S, Y123H, V82S, T166R, and/or Q154R. The alteration Y123H is also referred to herein as H123H (the alteration H123Y in TadA*7.10 reverted back to Y123H (wt)). In other embodiments, a variant of the TadA*7.10 sequence comprises a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In other embodiments, the invention provides adenosine deaminase variants that include deletions, e.g., TadA*8, comprising a deletion of the C terminus beginning at residue 149, 150, 151, 152, 153, 154, 155, 156, or 15, relative to TadA*7.10, the TadA reference sequence, or a corresponding mutation in another TadA 7. In other embodiments, the adenosine deaminase variant is a TadA (e.g., TadA*8) monomer comprising one or more of the following alterations: Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a monomer comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In still other embodiments, the adenosine deaminase variant is a homodimer comprising two adenosine deaminase domains (e.g., TadA*8) each having one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a homodimer comprising two adenosine deaminase domains (e.g., TadA*8) each having a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In other embodiments, the adenosine deaminase variant is a heterodimer comprising a wild-type TadA adenosine deaminase domain and an adenosine deaminase variant domain (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a heterodimer comprising a wild-type TadA adenosine deaminase domain and an adenosine deaminase variant domain (e.g. TadA*8) comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In other embodiments, the adenosine deaminase variant is a heterodimer comprising a TadA*7.10 domain and an adenosine deaminase variant domain (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant is a heterodimer comprising a TadA*7.10 domain and an adenosine deaminase variant domain (e.g. TadA*8) comprising a combination of the following alterations: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; or I76Y+V82S+Y123H+

Y147R+Q154R, relative to TadA*7.10, the TadA reference sequence, or a corresponding mutation in another TadA.

In one embodiment, the adenosine deaminase is a TadA*8 that comprises or consists essentially of the following sequence or a fragment thereof having adenosine deaminase activity:

MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCT
FFRMPRQVFNAQKKAQSSTD (SEQ ID NO: 13).

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In particular embodiments, an adenosine deaminase heterodimer comprises an TadA*8 domain and an adenosine deaminase domain selected from one of the following:

*Staphylococcus aureus* (*S. aureus*) TadA:
MGSHMTNDIYFMTLAIEEAKKAAQLGEVPIGAIITKDDEVIARAHNLRE
TLQQPTAHAEHIAIERAAKVLGSWRLEGCTLYVTLEPCVMCAGTIVMSR
IPRVVYGADDPKGGCSGSLMNLLQQSNFNHRAIVDKGVLKEACSTLLTT
FFKNLRANKKSTN (SEQ ID NO: 5)

*Bacillus subtilis* (*B. subtilis*) TadA:
MTQDELYMKEAIKEAKKAEEKGEVPIGAVLVINGEIIARAHNLRETEQR
SIAHAEMLVIDEACKALGTWRLEGATLYVTLEPCPMCAGAVVLSRVEKV
VFGAFDPKGGCSGTLMNLLQEERFNHQAEVVSGVLEEECGGMLSAFFRE
LRKKKKAARKNLSE (SEQ ID NO: 6)

*Salmonella typhimurium* (*S. typhimurium*) TadA:
MPPAFITGVTSLSDVELDHEYWMRHALTLAKRAWDEREVPVGAVLVHNH
RVIGEGWNRPIGRHDPTAHAEIMALRQGGLVLQNYRLLDTTLYVTLEPC
VMCAGAMVHSRIGRVVFGARDAKTGAAGSLIDVLHHPGMNHRVEIIEGV
LRDECATLLSDFFRMRRQEIKALKKADRAEGAGPAV
(SEQ ID NO: 7)

*Shewanella putrefaciens* (*S. putrefaciens*) TadA:
MDEYWMQVAMQMAEKAEAAGEVPVGAVLVKDGQQIATGYNLSISQHDPT
AHAEILCLRSAGKKLENYRLLDATLYITLEPCAMCAGAMVHSRIARVVY
GARDEKTGAAGTVVNLLQHPAFNHQVEVTSGVLAEACSAQLSRFFKRRR
DEKKALKLAQRAQQGIE (SEQ ID NO: 8)

*Haemophilus influenzae* F3031 (*H. influenzae*) TadA:
MDAAKVRSEFDEKMMRYALELADKAEALGEIPVGAVLVDDARNIIGEGW
NLSIVQSDPTAHAEIIALRNGAKNIQNYRLLNSTLYVTLEPCTMCAGAI
LHSRIKRLVFGASDYKTGAIGSRFHFFDDYKMNHTLEITSGVLAEECSQ
KLSTFFQKRREEKKIEKALLKSLSDK (SEQ ID NO: 9)

*Caulobacter crescentus* (*C. crescentus*) TadA:
MRTDESEDQDHRMMRLALDAARAAAEAGETPVGAVILDPSTGEVIATAG
NGPIAAHDPTAHAEIAAMRAAAAKLGNYRLTDLTLVVTLEPCAMCAGAI
SHARIGRVVFGADDPKGGAVVHGPKFFAQPTCHWRPEVTGGVLADESAD
LLRGFFRARRKAKI (SEQ ID NO: 10)

*Geobacter sulfurreducens* (*G. sulfurreducens*) TadA:
MSSLKKTPIRDDAYWMGKAIREAAKAAARDEVPIGAVIVRDGAVIGRGH
NLREGSNDPSAHAEMIAIRQAARRSANWRLTGATLYVTLEPCLMCMGAI
ILARLERVVFGCYDPKGGAAGSLYDLSADPRLNHQVRLSPGVCQEECGT
MLSDFFRDLRRRKKAKATPALFIDERKVPPEP (SEQ ID NO: 11)

TadA*7.10
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCY
FFRMPRQVFNAQKKAQSSTD (SEQ ID NO: 3)

By "Adenosine Deaminase Base Editor 8 (ABE8) polypeptide" or "ABE8" is meant a base editor as defined herein comprising an adenosine deaminase variant comprising an alteration at amino acid position 82 and/or 166 of the following reference sequence:

MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCY
FFRMPRQVFNAQKKAQSSTD (SEQ ID NO: 3)

In some embodiments, ABE8 comprises further alterations, as described herein, relative to the reference sequence.

By "Adenosine Deaminase Base Editor 8 (ABE8) polynucleotide" is meant a polynucleotide encoding an ABE8.

"Administering" is referred to herein as providing one or more compositions described herein to a patient or a subject. By way of example and without limitation, composition administration, e.g., injection, can be performed by intravenous (i.v.) injection, sub-cutaneous (s.c.) injection, intradermal (i.d.) injection, intraperitoneal (i.p.) injection, or intramuscular (i.m.) injection. One or more such routes can be employed. Parenteral administration can be, for example, by bolus injection or by gradual perfusion over time. Alternatively, or concurrently, administration can be by the oral route.

By "agent" is meant any small molecule chemical compound, antibody, nucleic acid molecule, or polypeptide, or fragments thereof.

By "alteration" is meant a change (e.g. increase or decrease) in the structure, expression levels or activity of a gene or polypeptide as detected by standard art known methods such as those described herein. As used herein, an alteration includes a change in a polynucleotide or polypeptide sequence or a change in expression levels, such as a 25% change, a 40% change, a 50% change, or greater.

By "ameliorate" is meant decrease, suppress, attenuate, diminish, arrest, or stabilize the development or progression of a disease.

By "analog" is meant a molecule that is not identical, but has analogous functional or structural features. For example, a polynucleotide or polypeptide analog retains the biological activity of a corresponding naturally-occurring polynucleotide or polypeptide, while having certain modifications that enhance the analog's function relative to a naturally occurring polynucleotide or polypeptide. Such modifications could increase the analog's affinity for DNA, efficiency, specificity, protease or nuclease resistance, membrane permeability, and/or half-life, without altering, for example, ligand binding. An analog may include an unnatural nucleotide or amino acid.

By "base editor (BE)" or "nucleobase editor (NBE)" is meant an agent that binds a polynucleotide and has nucleobase modifying activity. In various embodiment, the base editor comprises a nucleobase modifying polypeptide (e.g., a deaminase) and a nucleic acid programmable nucleotide binding domain in conjunction with a guide polynucleotide (e.g., guide RNA). In various embodiments, the agent is a biomolecular complex comprising a protein domain having base editing activity, i.e., a domain capable of modifying a base (e.g., A, T, C, G, or U) within a nucleic acid molecule (e.g., DNA). In some embodiments, the polynucleotide programmable DNA binding domain is fused or linked to a deaminase domain. In one embodiment, the agent is a fusion protein comprising a domain having base editing activity. In another embodiment, the protein domain having base editing activity is linked to the guide RNA (e.g., via an RNA binding motif on the guide RNA and an RNA binding domain fused to the deaminase). In some embodiments, the domain having base editing activity is capable of deaminating a base within a nucleic acid molecule. In some embodiments, the base editor is capable of deaminating one or more bases within a DNA molecule. In some embodiments, the base editor is capable of deaminating an adenosine (A) within DNA. In some embodiments, the base editor is an adenosine base editor (ABE).

By way of example, a cytidine base editor (CBE) as used in the base editing compositions, systems and methods described herein has the following nucleic acid sequence (8877 base pairs), (Addgene, Watertown, Mass.; Komor A C, et al., 2017, Sci Adv., 30; 3(8):eaao4774. doi: 10.1126/sciadv.aao4774) as provided below. Polynucleotide sequences having at least 95% or greater identity to the BE4 nucleic acid sequence are also encompassed.

```
   1   atatgccaag tacgccccct attgacgtca atgacggtaa atggcccgcc tggcattatg
  61   cccagtacat gaccttatgg gactttccta cttggcagta catctacgta ttagtcatcg
 121   ctattaccat ggtgatgcgg ttttggcagt acatcaatgg gcgtggatag cggtttgact
 181   cacggggatt tccaagtctc cacccattg acgtcaatgg gagtttgttt tggcaccaaa
 241   atcaacggga ctttccaaaa tgtcgtaaca actccgcccc attgacgcaa atgggcggta
 301   ggcgtgtacg gtgggaggtc tatataagca gagctggttt agtgaaccgt cagatccgct
 361   agagatccgc ggccgctaat acgactcact atagggagag ccgccaccat gagctcagag
 421   actgcccag tggctgtgga ccccacattg agacggcgga tcgagcccca tgagtttgag
 481   gtattcttcg atccgagaga gctccgcaag gagacctgcc tgctttacga aattaattgg
 541   gggggccggc actccatttg gcgacataca tcacagaaca ctaacaagca cgtcgaagtc
 601   aacttcatcg agaagttcac gacagaaaga tatttctgtc cgaacacaag gtgcagcatt
 661   acctggtttc tcagctggag cccatgcggc gaatgtagta gggccatcac tgaattcctg
 721   tcaaggtatc cccacgtcac tctgtttatt tacatcgcaa ggctgtacca ccacgctgac
 781   ccccgcaatc gacaaggcct gcgggatttg atctcttcag gtgtgactat ccaaattatg
 841   actgagcagg agtcaggata ctgctggaga aactttgtga attatagccc gagtaatgaa
 901   gcccactggc ctaggtatcc ccatctgtgg gtacgactgt acgttcttga actgtactgc
 961   atcatactgg gcctgcctcc ttgtctcaac attctgagaa ggaagcagcc acagctgaca
1021   ttctttacca tcgctcttca gtcttgtcat taccagcgac tgccccaca cattctctgg
1081   gccaccgggt tgaaatctgg tggttcttct ggtggttcta gcggcagcga gactcccggg
1141   acctcagagt ccgccacacc cgaaagttct ggtggttctt ctggtggttc tgataaaaag
1201   tattctattg gtttagccat cggcactaat tccgttggat gggctgtcat aaccgatgaa
1261   tacaaagtac cttcaaagaa atttaaggtg ttggggaaca cagaccgtca ttcgattaaa
1321   aagaatctta tcggtgccct cctattcgat agtggcgaaa cggcagaggc gactcgcctg
1381   aaacgaaccg ctcggagaag gtatacacgt cgcaagaacc gaatatgtta cttacaagaa
1441   atttttagca atgagatggc caaagttgac gattctttct ttcaccgttt ggaagagtcc
1501   ttccttgtcg aagaggacaa gaaacatgaa cggcacccca tctttggaaa catagtagat
1561   gaggtggcat atcatgaaaa gtacccaacg atttatcacc tcagaaaaaa gctagttgac
```

-continued

```
1621  tcaactgata aagcggacct gaggttaatc tacttggctc ttgcccatat gataaagttc
1681  cgtgggcact ttctcattga gggtgatcta aatccggaca actcggatgt cgacaaactg
1741  ttcatccagt tagtacaaac ctataatcag ttgtttgaag agaaccctat aaatgcaagt
1801  ggcgtggatg cgaaggctat tcttagcgcc cgcctctcta aatcccgacg gctagaaaac
1861  ctgatcgcac aattacccgg agagaagaaa aatgggttgt tcggtaacct tatagcgctc
1921  tcactaggcc tgacaccaaa ttttaagtcg aacttcgact tagctgaaga tgccaaattg
1981  cagcttagta aggacacgta cgatgacgat ctcgacaatc tactggcaca aattggagat
2041  cagtatgcgg acttattttt ggctgccaaa aaccttagcg atgcaatcct cctatctgac
2101  atactgagag ttaatactga gattaccaag gcgccgttat ccgcttcaat gatcaaaagg
2161  tacgatgaac atcaccaaga cttgacactt ctcaaggccc tagtccgtca gcaactgcct
2221  gagaaatata aggaaatatt ctttgatcag tcgaaaaacg ggtacgcagg ttatattgac
2281  ggcggagcga gtcaaggaga attctacaag tttatcaaac ccatattaga gaagatggat
2341  gggacggaag agttgcttgt aaaactcaat cgcgaagatc tactgcgaaa gcagcggact
2401  ttcgacaacg gtagcattcc acatcaaatc cacttaggcg aattgcatgc tatacttaga
2461  aggcaggagg atttttatcc gttcctcaaa gacaatcgtg aaaagattga gaaaatccta
2521  acctttcgca taccttacta tgtgggaccc ctggcccgag ggaactctcg gttcgcatgg
2581  atgacaagaa agtccgaaga aacgattact ccatggaatt ttgaggaagt tgtcgataaa
2641  ggtgcgtcag ctcaatcgtt catcgagagg atgaccaact ttgacaagaa tttaccgaac
2701  gaaaaagtat tgcctaagca cagtttactt tacgagtatt tcacagtgta caatgaactc
2761  acgaaagtta agtatgtcac tgagggcatg cgtaaacccg cctttctaag cggagaacag
2821  aagaaagcaa tagtagatct gttattcaag accaaccgca aagtgacagt taagcaattg
2881  aaagaggact actttaagaa aattgaatgc ttcgattctg tcgagatctc cggggtagaa
2941  gatcgattta atgcgtcact tggtacgtat catgacctcc taaagataat taaagataag
3001  gacttcctgg ataacgaaga gaatgaagat atcttagaag atatagtgtt gactcttacc
3061  ctctttgaag atcgggaaat gattgaggaa agactaaaaa catacgctca cctgttcgac
3121  gataaggtta tgaaacagtt aaagaggcgt cgctatacgg gctggggacg attgtcgcgg
3181  aaacttatca acgggataag agacaagcaa agtggtaaaa ctattctcga ttttctaaag
3241  agcgacggct tcgccaatag gaactttatg cagctgatcc atgatgactc tttaaccttc
3301  aaagaggata tacaaaaggc acaggtttcc ggacaagggg actcattgca cgaacatatt
3361  gcgaatcttg ctggttcgcc agccatcaaa aagggcatac tccagacagt caaagtagtg
3421  gatgagctag ttaaggtcat gggacgtcac aaaccggaaa acattgtaat cgagatggca
3481  cgcgaaaatc aaacgactca gaagggcaaa aaaacagtc gagagcggat gaagagaata
3541  gaagagggta ttaaagaact gggcagccag atcttaaagg agcatcctgt ggaaaatacc
3601  caattgcaga acgagaaact ttacctctat tacctacaaa atggaaggga catgtatgtt
3661  gatcaggaac tggacataaa ccgtttatct gattacgacg tcgatcacat tgtaccccaa
3721  tcctttttga aggacgattc aatcgacaat aaagtgctta cacgctcgga taagaaccga
3781  gggaaaagtg acaatgttcc aagcgaggaa gtcgtaagaa aaatgaagaa ctattggcgg
3841  cagctcctaa atgcgaaact gataacgcaa agaaagttcg ataacttaac taaagctgag
3901  aggggtggct tgtctgaact tgacaaggcc ggatttatta acgtcagct cgtggaaacc
3961  cgccaaatca caaagcatgt tgcacagata ctagattccc gaatgaatac gaaatacgac
```

```
4021  gagaacgata agctgattcg ggaagtcaaa gtaatcactt taaagtcaaa attggtgtcg
4081  gacttcagaa aggattttca attctataaa gttagggaga taaataacta ccaccatgcg
4141  cacgacgctt atcttaatgc cgtcgtaggg accgcactca ttaagaaata cccgaagcta
4201  gaaagtgagt ttgtgtatgg tgattacaaa gtttatgacg tccgtaagat gatcgcgaaa
4261  agcgaacagg agataggcaa ggctacagcc aaatacttct tttattctaa cattatgaat
4321  ttctttaaga cggaaatcac tctggcaaac ggagagatac gcaaacgacc tttaattgaa
4381  accaatgggg agacaggtga aatcgtatgg gataagggcc gggacttcgc gacggtgaga
4441  aaagttttgt ccatgcccca agtcaacata gtaaagaaaa ctgaggtgca gaccggaggg
4501  ttttcaaagg aatcgattct tccaaaaagg aatagtgata agctcatcgc tcgtaaaaag
4561  gactgggacc cgaaaaagta cggtggcttc gatagcccta cagttgccta ttctgtccta
4621  gtagtggcaa aagttgagaa gggaaaatcc aagaaactga agtcagtcaa agaattattg
4681  gggataacga ttatggagcg ctcgtctttt gaaaagaacc ccatcgactt ccttgaggcg
4741  aaaggttaca aggaagtaaa aaaggatctc ataattaaac taccaaagta tagtctgttt
4801  gagttagaaa atggccgaaa acgatgttg gctagcgccg gagagcttca aaaggggaac
4861  gaactcgcac taccgtctaa atacgtgaat ttcctgtatt tagcgtccca ttacgagaag
4921  ttgaaaggtt cacctgaaga taacgaacag aagcaacttt tgttgagca gcacaaacat
4981  tatctcgacg aaatcataga gcaaatttcg gaattcagta agagagtcat cctagctgat
5041  gccaatctgg acaaagtatt aagcgcatac aacaagcaca gggataaacc catacgtgag
5101  caggcggaaa atattatcca tttgtttact cttaccaacc tcggcgctcc agccgcattc
5161  aagtattttg acacaacgat agatcgcaaa cgatacactt ctaccaagga ggtgctagac
5221  gcgacactga ttcaccaatc catcacggga ttatatgaaa ctcggataga tttgtcacag
5281  cttggggtg actctggtgg ttctggagga tctggtggtt ctactaatct gtcagatatt
5341  attgaaaagg agaccggtaa gcaactggtt atccaggaat ccatcctcat gctcccagag
5401  gaggtggaag aagtcattgg gaacaagccg gaaagcgata tactcgtgca caccgcctac
5461  gacgagagca ccgacgagaa tgtcatgctt ctgactagcg acgcccctga atacaagcct
5521  tgggctctgg tcatacagga tagcaacggt gagaacaaga ttaagatgct ctctggtggt
5581  tctggaggat ctggtggttc tactaatctg tcagatatta ttgaaaagga gaccggtaag
5641  caactggtta tccaggaatc catcctcatg ctcccagagg aggtggaaga agtcattggg
5701  aacaagccgg aaagcgatat actcgtgcac accgcctacg acgagagcac cgacgagaat
5761  gtcatgcttc tgactagcga cgcccctgaa tacaagcctt gggctctggt catacaggat
5821  agcaacggtg agaacaagat taagatgctc tctggtggtt ctcccaagaa gaagaggaaa
5881  gtctaaccgg tcatcatcac catcaccatt gagtttaaac ccgctgatca gcctcgactg
5941  tgccttctag ttgccagcca tctgttgttt gcccctcccc cgtgccttcc ttgaccctgg
6001  aaggtgccac tcccactgtc ctttcctaat aaaatgagga aattgcatcg cattgtctga
6061  gtaggtgtca ttctattctg gggggtgggg tggggcagga cagcaagggg gaggattggg
6121  aagacaatag caggcatgct ggggatgcgg tgggctctat ggcttctgag gcggaaagaa
6181  ccagctgggg ctcgataccg tcgacctcta gctagagctt ggcgtaatca tggtcatagc
6241  tgtttcctgt gtgaaattgt tatccgctca caattccaca acatacga gccggaagca
6301  taaagtgtaa agcctagggt gcctaatgag tgagctaact cacattaatt gcgttgcgct
6361  cactgcccgc tttccagtcg ggaaacctgt cgtgccagct gcattaatga atcggccaac
6421  gcgcggggag aggcggtttg cgtattgggc gctcttccgc ttcctcgctc actgactcgc
```

-continued

```
6481  tgcgctcggt cgttcggctg cggcgagcgg tatcagctca ctcaaaggcg gtaatacggt
6541  tatccacaga atcaggggat aacgcaggaa agaacatgtg agcaaaaggc cagcaaaagg
6601  ccaggaaccg taaaaaggcc gcgttgctgg cgttttttcca taggctccgc cccctgacg
6661  agcatcacaa aaatcgacgc tcaagtcaga ggtggcgaaa cccgacagga ctataaagat
6721  accaggcgtt tccccctgga agctccctcg tgcgctctcc tgttccgacc ctgccgctta
6781  ccggatacct gtccgccttt ctcccttcgg gaagcgtggc gctttctcat agctcacgct
6841  gtaggtatct cagttcggtg taggtcgttc gctccaagct gggctgtgtg cacgaaccc
6901  ccgttcagcc cgaccgctgc gccttatccg gtaactatcg tcttgagtcc aacccggtaa
6961  gacacgactt atcgccactg gcagcagcca ctggtaacag gattagcaga gcgaggtatg
7021  taggcggtgc tacagagttc ttgaagtggt ggcctaacta cggctacact agaagaacag
7081  tatttggtat ctgcgctctg ctgaagccag ttaccttcgg aaaaagagtt ggtagctctt
7141  gatccggcaa acaaaccacc gctggtagcg gtggtttttt tgtttgcaag cagcagatta
7201  cgcgcagaaa aaaggatct caagaagatc ctttgatctt ttctacgggg tctgacgctc
7261  agtggaacga aaactcacgt taagggattt tggtcatgag attatcaaaa aggatcttca
7321  cctagatcct tttaaattaa aaatgaagtt ttaaatcaat ctaaagtata tatgagtaaa
7381  cttggtctga cagttaccaa tgcttaatca gtgaggcacc tatctcagcg atctgtctat
7441  ttcgttcatc catagttgcc tgactccccg tcgtgtagat aactacgata cgggagggct
7501  taccatctgg ccccagtgct gcaatgatac cgcgagaccc acgctcaccg gctccagatt
7561  tatcagcaat aaaccagcca gccggaaggg ccgagcgcag aagtggtcct gcaactttat
7621  ccgcctccat ccagtctatt aattgttgcc gggaagctag agtaagtagt tcgccagtta
7681  atagtttgcg caacgttgtt gccattgcta caggcatcgt ggtgtcacgc tcgtcgtttg
7741  gtatggcttc attcagctcc ggttcccaac gatcaaggcg agttacatga tcccccatgt
7801  tgtgcaaaaa agcggttagc tccttcggtc ctccgatcgt tgtcagaagt aagttggccg
7861  cagtgttatc actcatggtt atggcagcac tgcataattc tcttactgtc atgccatccg
7921  taagatgctt ttctgtgact ggtgagtact caaccaagtc attctgagaa tagtgtatgc
7981  ggcgaccgag ttgctcttgc ccggcgtcaa tacgggataa taccgcgcca catagcagaa
8041  ctttaaaagt gctcatcatt ggaaaacgtt cttcggggcg aaaactctca aggatcttac
8101  cgctgttgag atccagttcg atgtaaccca ctcgtgcacc caactgatct tcagcatctt
8161  ttactttcac cagcgtttct gggtgagcaa aaacaggaag gcaaaatgcc gcaaaaaagg
8221  gaataagggc gacacggaaa tgttgaatac tcatactctt ccttttttcaa tattattgaa
8281  gcatttatca gggttattgt ctcatgagcg gatacatatt tgaatgtatt tagaaaaata
8341  aacaaatagg ggttccgcgc acatttcccc gaaaagtgcc acctgacgtc gacggatcgg
8401  gagatcgatc tcccgatccc ctagggtcga ctctcagtac aatctgctct gatgccgcat
8461  agttaagcca gtatctgctc cctgcttgtg tgttggaggt cgctgagtag tgcgcgagca
8521  aaatttaagc tacaacaagg caaggcttga ccgacaattg catgaagaat ctgcttaggg
8581  ttaggcgttt tgcgctgctt cgcgatgtac gggccagata tacgcgttga cattgattat
8641  tgactagtta ttaatagtaa tcaattacgg ggtcattagt tcatagccca tatatggagt
8701  tccgcgttac ataacttacg gtaaatggcc cgcctggctg accgcccaac gacccccgcc
8761  cattgacgtc aataatgacg tatgttccca tagtaacgcc aatagggact ttccattgac
8821  gtcaatgggt ggagtattta cggtaaactg cccacttggc agtacatcaa gtgtatc
         (SEQ ID NO: 24)
```

In some embodiments, the cytidine base editor is BE4 having a nucleic acid sequence selected from one of the following:

```
Original BE4 nucleic acid sequence:
ATGagctcagagactggcccagtggctgtggaccccacattgagacggcggatcgagcccatgagtt tgaggtattcttcgatccgagagagctccgcaaggagacctgcctgctttacgaaattaattgggggg gccggcactccatttggcgacatacatcacagaacactaacaagcacgtcgaagtcaacttcatcgag aagttcacgacagaaagatatttctgtccgaacacaaggtgcagcattacctggtttctcagctggag ccgcgaatgtagtagggccatcactgaattcctgtcaaggtatcccacgtcactctgtttatttaca tcgcaaggctgtaccaccacgctgaccccgcaatcgacaaggcctgcgggatttgatctcttcaggt gtgactatccaaattatgactgagcaggagtcaggatactgctggagaaactttgtgaattatagccc gagtaatgaagcccactggcctaggtatccccatctgtgggtacgactgtacgttcttgaactgtact gcatcatactgggcctgcctccttgtctcaacattctgagaaggaagcagccacagctgacattcttt accatcgctcttcagtcttgtcattaccagcgactgccccacacattctctgggccaccgggttgaa atctggtggttcttctggtggttctagcggcagcgagactcccgggacctcagagtccgccacacccg aaagttctggtggttcttctggtggttctgataaaaagtattctattggtttagccatcggcactaat tccgttggatgggctgtcataaccgatgaatacaaagtaccttcaaagaaatttaaggtgttggggaa cacagaccgtcattcgattaaaaagaatcttatcggtgccctcctattcgatagtggcgaaacggcag aggcgactcgcctgaaacgaaccgctcggagaaggtatacacgtcgcaagaaccgaatatgttactta caagaaatttttagcaatgagatggccaaagttgacgattctttctttcaccgtttggaagagtcctt ccttgtcgaagaggacaagaaacatgaacggcaccccatctttgaaacatagtagatgaggtggcat atcatgaaaagtacccaacgatttatcacctcagaaaaaagctagttgactcaactgataaagcggac ctgaggttaatctacttggctcttgcccatatgataaagttccgtgggcactttctcattgagggtga tctaaatccggacaactcggatgtcgacaaactgttcatccagttagtacaaacctataatcagttgt ttgaagagaaccctataaatgcaagtggcgtggatgcgaaggctattcttagcgcccgcctctctaaa tcccgacggctagaaaacctgatcgcacaattacccggagagaagaaaaatgggttgttcggtaacct tatagcgctctcactaggcctgacaccaaattttaagtcgaacttcgacttagctgaagatgccaaat tgcagcttagtaaggacacgtacgatgacgatctcgacaatctactggcacaaattggagatcagtat gcggacttatttttggctgccaaaaaccttagcgatgcaatcctcctatctgacatactgagagttaa tactgagattaccaaggcgccgttatccgcttcaatgatcaaaaggtacgatgaacatcaccaagact tgacacttctcaaggccctagtccgtcagcaactgcctgagaaatataaggaaatattctttgatcag tcgaaaaacgggtacgcaggttatattgacggcggagcgagtcaagaggaattctacaagtttatcaa acccatattagagaagatggatgggacggaagagttgcttgtaaaactcaatcgcgaagatctactgc gaaagcagcggactttcgacaacggtagcattccacatcaaatccacttaggcgaattgcatgctata cttagaaggcaggaggattttatccgttcctcaaagacaatcgtgaaaagattgagaaaatcctaac ctttcgcatacctactatgtgggaccctggcccgagggaactctcggttcgcatggatgacaagaa agtccgaagaaacgattactccatggaattttgaggaagttgtcgataaaggtgcgtcagctcaatcg ttcatcgagaggatgaccaactttgacaagaatttaccgaacgaaaaagtattgcctaagcacagttt actttacgagtatttcacagtgtacaatgaactcacgaaagttaagtatgtcactgagggcatgcgta aacccgcctttctaagcggagaacagaagaaagcaatagtagatctgttattcaagaccaaccgcaaa gtgacagttaagcaattgaaagaggactactttaagaaaattgaatgcttcgattctgtcgagatctc cggggtagaagatcgatttaatgcgtcacttggtacgtatcatgacctcctaaagataattaaagata
```

-continued

```
aggacttcctggataacgaagagaatgaagatatcttagaagatatagtgttgactcttaccctcttt gaagatcgggaaatgattgaggaaagactaaaaacatacgctcacctgttcgacgataaggttatgaa acagttaaagaggcgtcgctatacgggctggggacgattgtcgcggaaacttatcaacgggataagag acaagcaaagtggtaaaactattctcgattttctaaagagcgacggcttcgccaataggaactttatg cagctgatccatgatgactctttaaccttcaaagaggatatacaaaaggcacaggtttccggacaagg ggactcattgcacgaacatattgcgaatcttgctggttcgccagccatcaaaaagggcatactccaga cagtcaaagtagtggatgagctagttaaggtcatgggacgtcacaaaccggaaaacattgtaatcgag atggcacgcgaaaatcaaacgactcagaaggggcaaaaaaacagtcgagagcggatgaagagaataga agagggtattaaagaactgggcagccagatcttaaaggagcatcctgtggaaaatacccaattgcaga acgagaaactttacctctattacctacaaaatggaagggacatgtatgttgatcaggaactggacata aaccgtttatctgattacgacgtcgatcacattgtaccccaatccttttgaaggacgattcaatcga caataaagtgcttacacgctcggataagaaccgagggaaaagtgacaatgttccaagcgaggaagtcg taaagaaaatgaagaactattggcggcagctcctaaatgcgaaactgataacgcaaagaaagttcgat aacttaactaaagctgagaggggtggcttgtctgaacttgacaaggccggatttattaaacgtcagct cgtggaaacccgccaaatcacaaagcatgttgcacagatactagattcccgaatgaatacgaaatacg acgagaacgataagctgattcgggaagtcaaagtaatcactttaaagtcaaaattggtgtcggacttc agaaaggattttcaattctataaagttagggagataaataactaccaccatgcgcacgacgcttatct taatgccgtcgtagggaccgcactcattaagaaatacccgaagctagaaagtgagtttgtgtatggtg attacaaagtttatgacgtccgtaagatgatcgcgaaaagcgaacaggagataggcaaggctacagcc aaatacttcttttattctaacattatgaatttctttaagacggaaatcactctggcaaacggagagat acgcaaacgacctttaattgaaaccaatgggagacaggtgaaatcgtatgggataagggccgggact tcgcgacggtgagaaaagttttgtccatgccccaagtcaacatagtaaagaaaactgaggtgcagacc ggagggttttcaaaggaatcgattcttccaaaaaggaatagtgataagctcatcgctcgtaaaaagga ctgggacccgaaaaagtacggtggcttcgatagccctacagttgcctattctgtcctagtagtggcaa aagttgagaagggaaaatccaagaaactgaagtcagtcaaagaattattggggataacgattatggag cgctcgtcttttgaaaagaaccccatcgacttccttgaggcgaaaggttacaaggaagtaaaaaagga tctcataattaaactaccaaagtatagtctgtttgagttagaaaatggccgaaaacggatgttggcta gcgccggagagcttcaaaaggggaacgaactcgcactaccgtctaaatacgtgaatttcctgtattta gcgtcccattacgagaagttgaaaggttcacctgaagataacgaacagaagcaacttttttgttgagca gcacaaacattatctcgacgaaatcatagagcaaatttcggaattcagtaagagagtcatcctagctg atgccaatctggacaaagtattaagcgcatacaacaagcacaggdataaacccatacgtgagcaggcg gaaaatattatccatttgtttactcttaccaacctcggcgctccagccgcattcaagtattttgacac aacgatagatcgcaaacgatacacttctaccaaggaggtgctagacgcgacactgattcaccaatcca tcacgggattatatgaaactcggatagatttgtcacagcttgggggtgactctggtggttctggagga tctggtggttctactaatctgtcagatattattgaaaaggagaccggtaagcaactggttatccagga atccatcctcatgctcccagaggaggtggaagaagtcattgggaacaagccggaaagcgatatactcg tgcacaccgcctacgacgagagcaccgacgagaatgtcatgcttctgactagcgacgcccctgaatac aagccttgggctctggtcatacaggatagcaacggtgagaacaagattaagatgctctctggtggttc tggaggatctggtggttctactaatctgtcagatattattgaaaaggagaccggtaagcaactggtta tccaggaatccatcctcatgctcccagaggaggtggaagaagtcattgggaacaagccggaaagcgat
```

-continued atactcgtgcacaccgcctacgacgagagcaccgacgagaatgtcatgcttctgactagcgacgcccc tgaatacaagccttgggctctggtcatacaggatagcaacggtgagaacaagattaagatgctctctg gtggttctAAAAGGACGGCGGACGGATCAGAGTTCGAGAGTCCGCGAAAGGTCGAAtaa
(SEQ ID NO: 25)

BE4 Codon Optimization 1 nucleic acid sequence:
ATGTCATCCGAAACCGGGCCAGTGGCCGTAGACCCAACACTCAGGAGGCGGATAGAACCCCATGAGTT

TGAAGTGTTCTTCGACCCCAGAGAGCTGCGCAAAGAGACTTGCCTCCTGTATGAAATAAATTGGGGGG

GTCGCCATTCAATTTGGAGGCACACTAGCCAGAATACTAACAAACACGTGGAGGTAAATTTTATCGAG

AAGTTTACCACCGAAAGATACTTTTGCCCCAATACACGGTGTTCAATTACCTGGTTTCTGTCATGGAG

TCCATGTGGAGAATGTAGTAGAGCGATAACTGAGTTCCTGTCTCGATATCCTCACGTCACGTTGTTTA

TATACATCGCTCGGCTTTATCACCATGCGGACCCGCGGAACAGGCAAGGTCTTCGGGACCTCATATCC

TCTGGGGTGACCATCCAGATAATGACGGAGCAAGAGAGCGGATACTGCTGGCGAAACTTTGTTAACTA

CAGCCCAAGCAATGAGGCACACTGGCCTAGATATCCGCATCTCTGGGTTCGACTGTATGTCCTTGAAC

TGTACTGCATAATTCTGGGACTTCCGCCATGCTTGAACATTCTGCGGCGGAAACAACCACAGCTGACC

TTTTTCACGATTGCTCTCCAAAGTTGTCACTACCAGCGATTGCCACCCCACATCTTGTGGGCTACTGG

ACTCAAGTCTGGAGGAAGTTCAGGCGGAAGCAGCGGGTCTGAAACGCCCGGAACCTCAGAGAGCGCAA

CGCCCGAAAGCTCTGGAGGGTCAAGTGGTGGTAGTGATAAGAAATACTCCATCGGCCTCGCCATCGGT

ACGAATTCTGTCGGTTGGGCCGTTATCACCGATGAGTACAAGGTCCCTTCTAAGAAATTCAAGGTTTT

GGGCAATACAGACCGCCATTCTATAAAAAAAAAACCTGATCGGCGCCCTTTTGTTTGACAGTGGTGAGA

CTGCTGAAGCGACTCGCCTGAAGCGAACTGCCAGGAGGCGGTATACGAGGCGAAAAAACCGAATTTGT

TACCTCCAGGAGATTTTCTCAAATGAAATGGCCAAGGTAGATGATAGTTTTTTTCACCGCTTGGAAGA

AAGTTTTCTCGTTGAGGAGGACAAAAAGCACGAGAGGCACCCAATCTTTGGCAACATAGTCGATGAGG

TCGCATACCATGAGAAATATCCTACGATCTATCATCTCCGCAAGAAGCTGGTCGATAGCACGGATAAA

GCTGACCTCCGGCTGATCTACCTTGCTCTTGCTCACATGATTAAATTCAGGGGCCATTTCCTGATAGA

AGGAGACCTCAATCCCGACAATTCTGATGTCGACAAACTGTTTATTCAGCTCGTTCAGACCTATAATC

AACTCTTTGAGGAGAACCCCATCAATGCTTCAGGGGTGGACGCAAAGGCCATTTTGTCCGCGCGCTTG

AGTAAATCACGACGCCTCGAGAATTTGATAGCTCAACTGCCGGGTGAGAAGAAAAACGGGTTGTTTGG

GAATCTCATAGCGTTGAGTTTGGGACTTACGCCAAACTTTAAGTCTAACTTTGATTTGGCCGAAGATG

CCAAATTGCAGCTGTCCAAAGATACCTATGATGACGACTTGGATAACCTTCTTGCGCAGATTGGTGAC

CAATACGCGGATCTGTTTCTTGCCGCAAAAAATCTGTCCGACGCCATACTCTTGTCCGATATACTGCG

CGTCAATACTGAGATAACTAAGGCTCCCCTCAGCGCGTCCATGATTAAAAGATACGATGAGCACCACC

AAGATCTCACTCTGTTGAAAGCCCTGGTTCGCCAGCAGCTTCCAGAGAAGTATAAGGAGATATTTTTC

GACCAATCTAAAAACGGCTATGCGGGTTACATTGACGGTGGCGCCTCTCAAGAAGAATTCTACAAGTT

TATAAAGCCGATACTTGAGAAAATGGACGGTACAGAGGAATTGTTGGTTAAGCTCAATCGCGAGGACT

TGTTGAGAAAGCAGCGCACATTTGACAATGGTAGTATTCCACACCAGATTCATCTGGGCGAGTTGCAT

GCCATTCTTAGAAGACAAGAAGATTTTTATCCGTTTCTGAAAGATAACAGAGAAAAGATTGAAAAGAT

ACTTACCTTTCGCATACCGTATTATGTAGGTCCCCTGGCTAGAGGGAACAGTCGCTTCGCTTGGATGA

CTCGAAAATCAGAAGAAACAATAACCCCCTGGAATTTTGAAGAAGTGGTAGATAAAGGTGCGAGTGCC

CAATCTTTTATTGAGCGGATGACAAATTTTGACAAGAATCTGCCTAACGAAAAGGTGCTTCCCAAGCA

TTCCCTTTTGTATGAATACTTTACAGTATATAATGAACTGACTAAAGTGAAGTACGTTACCGAGGGGA

TGCGAAAGCCAGCTTTTCTCAGTGGCGAGCAGAAAAAAGCAATAGTTGACCTGCTGTTCAAGACGAAT

AGGAAGGTTACCGTCAAACAGCTCAAAGAAGATTACTTTAAAAAGATCGAATGTTTTGATTCAGTTGA

-continued

```
GATAAGCGGAGTAGAGGATAGATTTAACGCAAGTCTTGGAACTTATCATGACCTTTTGAAGATCATCA
AGGATAAAGATTTTTTGGACAACGAGGAGAATGAAGATATCCTGGAAGATATAGTACTTACCTTGACG
CTTTTTGAAGATCGAGAGATGATCGAGGAGCGACTTAAGACGTACGCACATCTCTTTGACGATAAGGT
TATGAAACAATTGAAACGCCGGCGGTATACTGGCTGGGGCAGGCTTTCTCGAAAGCTGATTAATGGTA
TCCGCGATAAGCAGTCTGGAAAGACAATCCTTGACTTTCTGAAAAGTGATGGATTTGCAAATAGAAAC
TTTATGCAGCTTATACATGATGACTCTTTGACGTTCAAGGAAGACATCCAGAAGGCACAGGTATCCGG
CCAAGGGGATAGCCTCCATGAACACATAGCCAACCTGGCCGGCTCACCAGCTATTAAAAAGGGAATAT
TGCAAACCGTTAAGGTTGTTGACGAACTCGTTAAGGTTATGGGCCGACACAAACCAGAGAATATCGTG
ATTGAGATGGCTAGGGAGAATCAGACCACTCAAAAAGGTCAGAAAAATTCTCGCGAAAGGATGAAGCG
AATTGAAGAGGGAATCAAAGAACTTGGCTCTCAAATTTTGAAAGAGCACCCGGTAGAAAACACTCAGC
TGCAGAATGAAAAGCTGTATCTGTATTATCTGCAGAATGGTCGAGATATGTACGTTGATCAGGAGCTG
GATATCAATAGGCTCAGTGACTACGATGTCGACCACATCGTTCCTCAATCTTTCCTGAAAGATGACTC
TATCGACAACAAAGTGTTGACGCGATCAGATAAGAACCGGGGAAAATCCGACAATGTACCCTCAGAAG
AAGTTGTCAAGAAGATGAAAAACTATTGGAGACAATTGCTGAACGCCAAGCTCATAACACAACGCAAG
TTCGATAACTTGACGAAAGCCGAAAGAGGTGGGTTGTCAGAATTGGACAAAGCTGGCTTTATTAAGCG
CCAATTGGTGGAGACCCGGCAGATTACGAAACACGTAGCACAAATTTTGGATTCACGAATGAATACCA
AATACGACGAAAACGACAAATTGATACGCGAGGTGAAAGTGATTACGCTTAAGAGTAAGTTGGTTTCC
GATTTCAGGAAGGATTTTCAGTTTTACAAAGTAAGAGAAATAAACAACTACCACCACGCCCATGATGC
TTACCTCAACGCGGTAGTTGGCACAGCTCTTATCAAAAAATATCCAAAGCTGGAAAGCGAGTTCGTTT
ACGGTGACTATAAAGTATACGACGTTCGGAAGATGATAGCCAAATCAGAGCAGGAAATTGGGAAGGCA
ACCGCAAAATACTTCTTCTATTCAAACATCATGAACTTCTTTAAGACGGAGATTACGCTCGCGAACGG
CGAAATACGCAAGAGGCCCCTCATAGAGACTAACGGCGAAACCGGGGAGATCGTATGGGACAAAGGAC
GGGACTTTGCGACCGTTAGAAAAGTACTTTCAATGCCACAAGTGAATATTGTTAAAAAGACAGAAGTA
CAAACAGGGGGGTTCAGTAAGGAATCCATTTTGCCCAAGCGGAACAGTGATAAATTGATAGCAAGGAA
AAAAGATTGGGACCCTAAGAAGTACGGTGGTTTCGACTCTCCTACCGTTGCATATTCAGTCCTTGTAG
TTGCGAAAGTGGAAAAGGGGAAAAGTAAGAAGCTTAAGAGTGTTAAAGAGCTTCTGGGCATAACCATA
ATGGAACGGTCTAGCTTCGAGAAAAATCCAATTGACTTTCTCGAGGCTAAAGGTTACAAGGAGGTAAA
AAAGGACCTGATAATTAAACTCCCAAAGTACAGTCTCTTCGAGTTGGAGAATGGGAGGAAGAGAATGT
TGGCATCTGCAGGGGAGCTCCAAAAGGGGAACGAGCTGGCTCTGCCTTCAAAATACGTGAACTTTCTG
TACCTGGCCAGCCACTACGAGAAACTCAAGGGTTCTCCTGAGGATAACGAGCAGAAACAGCTGTTTGT
AGAGCAGCACAAGCATTACCTGGACGAGATAATTGAGCAAATTAGTGAGTTCTCAAAAAGAGTAATCC
TTGCAGACGCGAATCTGGATAAAGTTCTTTCCGCCTATAATAAGCACCGGGACAAGCCTATACGAGAA
CAAGCCGAGAACATCATTCACCTCTTTACCCTTACTAATCTGGGCGCGCCGGCCGCCTTCAAATACTT
CGACACCACGATAGACAGGAAAAGGTATACGAGTACCAAAGAAGTACTTGACGCCACTCTCATCCACC
AGTCTATAACAGGGTTGTACGAAACGAGGATAGATTTGTCCCAGCTCGGCGGCGACTCAGGAGGGTCA
GGCGGCTCCGGTGGATCAACGAATCTTTCCGACATAATCGAGAAAGAAACCGGCAAACAGTTGGTGAT
CCAAGAATCAATCCTGATGCTGCCTGAAGAAGTAGAAGAGGTGATTGGCAACAAACCTGAGTCTGACA
TTCTTGTCCACACCGCGTATGACGAGAGCACGGACGAGAACGTTATGCTTCTCACTAGCGACGCCCCT
GAGTATAAACCATGGGCGCTGGTCATCCAAGATTCCAATGGGGAAAACAAGATTAAGATGCTTAGTGG
TGGGTCTGGAGGGAGCGGTGGGTCCACGAACCTCAGCGACATTATTGAAAAAGAGACTGGTAAACAAC
```

-continued

```
TTGTAATACAAGAGTCTATTCTGATGTTGCCTGAAGAGGTGGAGGAGGTGATTGGGAACAAACCGGAG

TCTGATATACTTGTTCATACCGCCTATGACGAATCTACTGATGAGAATGTGATGCTTTTaACGTCAGA

CGCTCCCGAGTACAAACCCTGGGCTCTGGTGATTCAGGACAGCAATGGTGAGAATAAGATTAAAATGT

TGAGTGGGGGCTCAAAGCGCACGGCTGACGGTAGCGAATTTGAGAGCCCCAAAAAAAAACGAAAGGTC

GAAtaa (SEQ ID NO: 26)

BE4 Codon Optimization 2 nucleic acid sequence:
ATGAGCAGCGAGACAGGCCCTGTGGCTGTGGATCCTACACTGCGGAGAAGAATCGAGCCCCACGAGTT

CGAGGTGTTCTTCGACCCCAGAGAGCTGCGGAAAGAGACATGCCTGCTGTACGAGATCAACTGGGGCG

GCAGACACTCTATCTGGCGGCACACAAGCCAGAACACCAACAAGCACGTGGAAGTGAACTTTATCGAG

AAGTTTACGACCGAGCGGTACTTCTGCCCCAACACCAGATGCAGCATCACCTGGTTTCTGAGCTGGTC

CCCTTGCGGCGAGTGCAGCAGAGCCATCACCGAGTTTCTGTCCAGATATCCCCACGTGACCCTGTTCA

TCTATATCGCCCGGCTGTACCACCACGCCGATCCTAGAAATAGACAGGGACTGCGCGACCTGATCAGC

AGCGGAGTGACCATCCAGATCATGACCGAGCAAGAGAGCGGCTACTGCTGGCGGAACTTCGTGAACTA

CAGCCCCAGCAACGAAGCCCACTGGCCTAGATATCCTCACCTGTGGGTCCGACTGTACGTGCTGGAAC

TGTACTGCATCATCCTGGGCCTGCCTCCATGCCTGAACATCCTGAGAAGAAAGCAGCCTCAGCTGACC

TTCTTCACAATCGCCCTGCAGAGCTGCCACTACCAGAGACTGCCTCCACACATCCTGTGGGCCACCGG

ACTTAAGAGCGGAGGATCTAGCGGCGGCTCTAGCGGATCTGAGACACCTGGCACAAGCGAGTCTGCCA

CACCTGAGAGTAGCGGCGGATCTTCTGGCGGCTCCGACAAGAAGTACTCTATCGGACTGGCCATCGGC

ACCAACTCTGTTGGATGGGCCGTGATCACCGACGAGTACAAGGTGCCCAGCAAGAAATTCAAGGTGCT

GGGCAACACCGACCGGCACAGCATCAAGAAGAATCTGATCGGCGCCCTGCTGTTCGACTCTGGCGAAA

CAGCCGAAGCCACCAGACTGAAGAGAACCGCCAGGCGGAGATACACCCGGCGGAAGAACCGGATCTGC

TACCTGCAAGAGATCTTCAGCAACGAGATGGCCAAGGTGGACGACAGCTTCTTCCACAGACTGGAAGA

GTCCTTCCTGGTGGAAGAGGACAAGAAGCACGAGCGGCACCCCATCTTCGGCAACATCGTGGATGAGG

TGGCCTACCACGAGAAGTACCCCACCATCTACCACCTGAGAAAGAAACTGGTGGACAGCACCGACAAG

GCCGACCTGAGACTGATCTACCTGGCTCTGGCCCACATGATCAAGTTCCGGGGCCACTTTCTGATCGA

GGGCGATCTGAACCCCGACAACAGCGACGTGGACAAGCTGTTCATCCAGCTGGTGCAGACCTACAACC

AGCTGTTCGAGGAAAACCCCATCAACGCCTCTGGCGTGGACGCCAAGGCTATCCTGTCTGCCAGACTG

AGCAAGAGCAGAAGGCTGGAAAACCTGATCGCCCAGCTGCCTGGCGAGAAGAAGAATGGCCTGTTCGG

CAACCTGATTGCCCTGAGCCTGGGACTGACCCCTAACTTCAAGAGCAACTTCGACCTGGCCGAGGATG

CCAAACTGCAGCTGAGCAAGGACACCTACGACGACGACCTGGACAATCTGCTGGCCCAGATCGGCGAT

CAGTACGCCGACTTGTTTCTGGCCGCCAAGAACCTGTCCGACGCCATCCTGCTGAGCGATATCCTGAG

AGTGAACACCGAGATCACAAAGGCCCCTCTGAGCGCCTCTATGATCAAGAGATACGACGAGCACCACC

AGGATCTGACCCTGCTGAAGGCCCTCGTTAGACAGCAGCTGCCAGAGAAGTACAAAGAGATTTTCTTC

GATCAGTCCAAGAACGGCTACGCCGGCTACATTGATGGCGGAGCCAGCCAAGAGGAATTCTACAAGTT

CATCAAGCCCATCCTGGAAAAGATGGACGGCACCGAGGAACTGCTGGTCAAGCTGAACAGAGAGGACC

TGCTGCGGAAGCAGCGGACCTTCGACAATGGCTCTATCCCTCACCAGATCCACCTGGGAGAGCTGCAC

GCCATTCTGCGGAGACAAGAGGACTTTTACCCATTCCTGAAGGACAACCGGGAAAAGATCGAGAAGAT

CCTGACCTTCAGGATCCCCTACTACGTGGGACCACTGGCCAGAGGCAATAGCAGATTCGCCTGGATGA

CCAGAAAGAGCGAGGAAACCATCACACCCTGGAACTTCGAGGAAGTGGTGGACAAGGGCGCCAGCGCT

CAGTCCTTCATCGAGCGGATGACCAACTTCGATAAGAACCTGCCTAACGAGAAGGTGCTGCCCAAGCA

CTCCCTGCTGTATGAGTACTTCACCGTGTACAACGAGCTGACCAAAGTGAAATACGTGACCGAGGGAA
```

-continued

```
TGAGAAAGCCCGCCTTTCTGAGCGGCGAGCAGAAAAAGGCCATTGTGGATCTGCTGTTCAAGACCAAC

CGGAAAGTGACCGTGAAGCAGCTGAAAGAGGACTACTTCAAGAAAATCGAGTGCTTCGACAGCGTGGA

AATCAGCGGCGTGGAAGATCGGTTCAATGCCAGCCTGGGCACATACCACGACCTGCTGAAAATTATCA

AGGACAAGGACTTCCTGGACAACGAAGAGAACGAGGACATTCTCGAGGACATCGTGCTGACCCTGACA

CTGTTTGAGGACAGAGAGATGATCGAGGAACGGCTGAAAACATACGCCCACCTGTTCGACGACAAAGT

GATGAAGCAACTGAAGCGGAGGCGGTACACAGGCTGGGGCAGACTGTCTCGGAAGCTGATCAACGGCA

TCCGGGATAAGCAGTCCGGCAAGACAATCCTGGATTTCCTGAAGTCCGACGGCTTCGCCAACAGAAAC

TTCATGCAGCTGATCCACGACGACAGCCTGACCTTTAAAGAGGACATCCAGAAAGCCCAGGTGTCCGG

CCAAGGCGATTCTCTGCACGAGCACATTGCCAACCTGGCCGGATCTCCCGCCATTAAGAAGGGCATCC

TGCAGACAGTGAAGGTGGTGGACGAGCTTGTGAAAGTGATGGGCAGACACAAGCCCGAGAACATCGTG

ATCGAAATGGCCAGAGAGAACCAGACCACACAGAAGGGCCAGAAGAACAGCCGCGAGAGAATGAAGCG

GATCGAAGAGGGCATCAAAGAGCTGGGCAGCCAGATCCTGAAAGAACACCCCGTGGAAAACACCCAGC

TGCAGAACGAGAAGCTGTACCTGTACTACCTGCAGAATGGACGGGATATGTACGTGGACCAAGAGCTG

GACATCAACCGGCTGAGCGACTACGATGTGGACCATATCGTGCCCCAGAGCTTTCTGAAGGACGACTC

CATCGATAACAAGGTCCTGACCAGAAGCGACAAGAACCGGGCAAGAGCGATAACGTGCCCTCCGAAG

AGGTGGTCAAGAAGATGAAGAACTACTGGCGACAGCTGCTGAACGCCAAGCTGATTACCCAGCGGAAG

TTCGATAACCTGACCAAGGCCGAGAGAGGCGGCCTGAGCGAACTTGATAAGGCCGGCTTCATTAAGCG

GCAGCTGGTGGAAACCCGGCAGATCACCAAACACGTGGCACAGATTCTGGACTCCCGGATGAACACTA

AGTACGACGAGAATGACAAGCTGATCCGGGAAGTGAAAGTCATCACCCTGAAGTCTAAGCTGGTGTCC

GATTTCCGGAAGGATTTCCAGTTCTACAAAGTGCGGGAAATCAACAACTACCATCACGCCCACGACGC

CTACCTGAATGCCGTTGTTGGAACAGCCCTGATCAAGAAGTATCCCAAGCTGGAAAGCGAGTTCGTGT

ACGGCGACTACAAGGTGTACGACGTGCGGAAGATGATCGCCAAGAGCGAACAAGAGATCGGCAAGGCT

ACCGCCAAGTACTTTTTCTACAGCAACATCATGAACTTTTTCAAGACAGAGATCACCCTGGCCAACGG

CGAGATCCGGAAAAGACCCCTGATCGAGACAAACGGCGAAACCGGGGAGATCGTGTGGGATAAGGGCA

GAGATTTTGCCACAGTGCGGAAAGTGCTGAGCATGCCCCAAGTGAATATCGTGAAGAAAACCGAGGTG

CAGACAGGCGGCTTCAGCAAAGAGTCTATCCTGCCTAAGCGGAACAGCGATAAGCTGATCGCCAGAAA

GAAGGACTGGGACCCTAAGAAGTACGGCGGCTTCGATAGCCCTACCGTGGCCTATTCTGTGCTGGTGG

TGGCCAAAGTGGAAAAGGGCAAGTCCAAAAAGCTCAAGAGCGTGAAAGAGCTGCTGGGGATCACCATC

ATGGAAAGAAGCAGCTTTGAGAAGAACCCGATCGACTTTCTGGAAGCCAAGGGCTACAAAGAAGTCAA

GAAGGACCTCATCATCAAGCTCCCCAAGTACAGCCTGTTCGAGCTGGAAAATGGCCGGAAGCGGATGC

TGGCCTCAGCAGGCGAACTGCAGAAAGGCAATGAACTGGCCCTGCCTAGCAAATACGTCAACTTCCTG

TACCTGGCCAGCCACTATGAGAAGCTGAAGGGCAGCCCCGAGGACAATGAGCAAAAGCAGCTGTTTGT

GGAACAGCACAAGCACTACCTGGACGAGATCATCGAGCAGATCAGCGAGTTCTCCAAGAGAGTGATCC

TGGCCGACGCTAACCTGGATAAGGTGCTGTCTGCCTATAACAAGCACCGGGACAAGCCTATCAGAGAG

CAGGCCGAGAATATCATCCACCTGTTTACCCTGACCAACCTGGGAGCCCCTGCCGCCTTCAAGTACTT

CGACACCACCATCGACCGGAAGAGGTACACCAGCACCAAAGAGGTGCTGGACGCCACACTGATCCACC

AGTCTATCACCGGCCTGTACGAAACCCGGATCGACCTGTCTCAGCTCGGCGGCGATTCTGGTGGTTCT

GGCGGAAGTGGCGGATCCACCAATCTGAGCGACATCATCGAAAAAGAGACAGGCAAGCAGCTCGTGAT

CCAAGAATCCATCCTGATGCTGCCTGAAGAGGTTGAGGAAGTGATCGGCAACAAGCCTGAGTCCGACA

TCCTGGTGCACACCGCCTACGATGAGAGCACCGATGAGAACGTCATGCTGCTGACAAGCGACGCCCCT

GAGTACAAGCCTTGGGCTCTCGTGATTCAGGACAGCAATGGGGAGAACAAGATCAAGATGCTGAGCGG
```

-continued

```
AGGTAGCGGAGGCAGTGGCGGAAGCACAAACCTGTCTGATATCATTGAAAAAGAAACCGGGAAGCAAC

TGGTCATTCAAGAGTCCATTCTCATGCTCCCGGAAGAAGTCGAGGAAGTCATTGGAAACAAACCCGAG

AGCGATATTCTGGTCCACACAGCCTATGACGAGTCTACAGACGAAAACGTGATGCTCCTGACCTCTGA

CGCTCCCGAGTATAAGCCCTGGGCACTTGTTATCCAGGACTCTAACGGGAAAACAAAATCAAAATGT

TGTCCGGCGGCAGCAAGCGGACAGCCGATGGATCTGAGTTCGAGAGCCCCAAGAAGAAACGGAAGGTg
```

GAGtaa (SEQ ID NO: 27)

In some embodiments, base editors are generated (e.g. ABE8) by cloning an adenosine deaminase variant (e.g., TadA*8) into a scaffold that includes a circular permutant Cas9 (e.g., spCAS9 or saCAS9) and a bipartite nuclear localization sequence. Circular permutant Cas9s are known in the art and described, for example, in Oakes et al., Cell 176, 254-267, 2019. Exemplary circular permutants follow where the bold sequence indicates sequence derived from Cas9, the italics sequence denotes a linker sequence, and the underlined sequence denotes a bipartite nuclear localization sequence.

CP5 (with MSP "NGC=Pam Variant with mutations Regular Cas9 likes NGG" PID=Protein Interacting Domain and "D10A" nickase):

```
EIGKATAKYFFYSNIMNFFKTEITLANGEIRKRPLIETNGETGEIVWD

KGRDFATVRKVLSMPQVNIVKKTEVQTGGFSKESILPKRNSDKLIARK

KDWDPKKYGGFMQPTVAYSVLVVAKVEKGKSKKLKSVKELLGITIMER

SSFEKNPIDFLEAKGYKEVKKDLIIKLPKYSLFELENGRKRMLASAKF

LQKGNELALPSKYVNFLYLASHYEKLKGSPEDNEQKQLFVEQHKHYLD

EIIEQISEFSKRVILADANLDKVLSAYNKHRDKPIREQAENIIHLFTL

TNLGAPRAFKYFDTTIARKEYRSTKEVLDATLIHQSITGLYETRIDLS

QLGGDGGSGGSGGSGGSGGSGGSGGMDKKYSIGLAIGTNSVGWAVITD

EYKVPSKKFKVLGNTDRHSIKKNLIGALLFDSGETAEATRLKRTARRR

YTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGH

FLIEGDLNPDNSDVDKLFIQLVQTYNQLFEENPINASGVDAKAILSAR

LSKSRRLENLIAQLPGEKKNGLFGNLIALSLGLTPNFKSNFDLAEDAK

LQLSKDTYDDDLDNLLAQIGDQYADLFLAAKNLSDAILLSDILRVNTE

ITKAPLSASMIKRYDEHHQDLTLLKALVRQQLPEKYKEIFFDQSKNGY

AGYIDGGASQEEFYKFIKPILEKMDGTEELLVKLNREDLLRKQRTFDN

GSIPHQIHLGELHAILRRQEDFYPFLKDNREKIEKILTFRIPYYVGPL

ARGNSRFAWMTRKSEETITPWNFEEVVDKGASAQSFIERMTNFDKNLP

NEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLK

IIKDKDFLDNEENEDILEDIVLTLTLFEDREMIEERLKTYAHLFDDKV

MKQLKRRRYTGWGRLSRKLINGIRDKQSGKTILDFLKSDGFANRNFMQ

LIHDDSLTFKEDIQKAQVSGQGDSLHEHIANLAGSPAIKKGILQTVKV

VDELVKVMGRHKPENIVIEMARENQTTQKGQKNSRERMKRIEEGIKEL
```

```
GSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLL

NAKLITQRKFDNLTKAERGGLSELDKAGFIKRQLVETRQITKHVAQIL

DSRMNTKYDENDKLIREVKVITLKSKLVSDFRKDFQFYKVREINNYHH

AHDAYLNAVVGTALIKKYPKLESEFVYGDYKVYDVRKMIAKSEQEGAD

KRTADGSEFESPKKKRKV* (SEQ ID NO: 12)
```

In some embodiments, the ABE8 is selected from a base editor from Table 7, 9, 14, or 15 infra. In some embodiments, ABE8 contains an adenosine deaminase variant evolved from TadA. In some embodiments, the adenosine deaminase variant of ABE8 is a TadA*8 variant as described in Table 7, 9, 14 or 15 infra. In some embodiments, the adenosine deaminase variant is TadA*7.10 variant (e.g. TadA*8) comprising one or more of an alteration selected from the group of Y147T, Y147R, Q154S, Y123H, V82S, T166R, and/or Q154R. In various embodiments, ABE8 comprises TadA*7.10 variant (e.g. TadA*8) with a combination of alterations selected from the group of Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R. In some embodiments ABE8 is a monomeric construct. In some embodiments, ABE8 is a heterodimeric construct. In some embodiments, the ABE8 comprises the sequence:

```
MSEVEFSHEYWMRHALTLAKRARDEREVPVGAVLVLNNRVIGEGWNRA

IGLHDPTAHAEIMALRQGGLVMQNYRLIDATLYVTFEPCVMCAGAMIH

SRIGRVVFGVRNAKTGAAGSLMDVLHYPGMNHRVEITEGILADECAAL

LCTFFRMPRQVFNAQKKAQSSTD (SEQ ID NO: 13).
```

In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. Details of base editors are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By way of example, the adenine base editor (ABE) as used in the base editing compositions, systems and methods described herein has the nucleic acid sequence (8877 base pairs), (Addgene, Watertown, Mass.; Gaudelli N M, et al., Nature. 2017 Nov. 23; 551(7681):464-471. doi: 10.1038/nature24644; Koblan L W, et al., Nat Biotechnol. 2018 October; 36(9):843-846. doi: 10.1038/nbt.4172.) as provided below. Polynucleotide sequences having at least 95% or greater identity to the ABE nucleic acid sequence are also encompassed.

```
ATATGCCAAGTACGCCCCCTATTGACGTCAATGACGGTAAATGGCCCGCCTGGCATTATGCCCAGTACAT
GACCTTATGGGACTTTCCTACTTGGCAGTACATCTACGTATTAGTCATCGCTATTACCATGGTGATGCGG
TTTTGGCAGTACATCAATGGGCGTGGATAGCGGTTTGACTCACGGGGATTTCCAAGTCTCCACCCCATTG
ACGTCAATGGGAGTTTGTTTTGGCACCAAAATCAACGGGACTTTCCAAAATGTCGTAACAACTCCGCCCC
ATTGACGCAAATGGGCGGTAGGCGTGTACGGTGGGAGGTCTATATAAGCAGAGCTGGTTTAGTGAACCGT
CAGATCCGCTAGAGATCCGCGGCCGCTAATACGACTCACTATAGGGAGAGCCGCCACCATGAAACGGACA
GCCGACGGAAGCGAGTTCGAGTCACCAAAGAAGAAGCGGAAAGTCTCTGAAGTCGAGTTTAGCCACGAGT
ATTGGATGAGGCACGCACTGACCCTGGCAAAGCGAGCATGGGATGAAAGAGAAGTCCCCGTGGGCGCCGT
GCTGGTGCACAACAATAGAGTGATCGGAGAGGGATGGAACAGGCCAATCGGCCGCCACGACCCTACCGCA
CACGCAGAGATCATGGCACTGAGGCAGGGAGGCCTGGTCATGCAGAATTACCGCCTGATCGATGCCACCC
TGTATGTGACACTGGAGCCATGCGTGATGTGCGCAGGAGCAATGATCCACAGCAGGATCGGAAGAGTGGT
GTTCGGAGCACGGGACGCCAAGACCGGCGCAGCAGGCTCCCTGATGGATGTGCTGCACCACCCCGGCATG
AACCACCGGGTGGAGATCACAGAGGGAATCCTGGCAGACGAGTGCGCCGCCCTGCTGAGCGATTTCTTTA
GAATGCGGAGACAGGAGATCAAGGCCCAGAAGAAGGCACAGAGCTCCACCGACTCTGGAGGATCTAGCGG
AGGATCCTCTGGAAGCGAGACACCAGGCACAAGCGAGTCCGCCACACCAGAGAGCTCCGGCGGCTCCTCC
GGAGGATCCTCTGAGGTGGAGTTTTCCCACGAGTACTGGATGAGACATGCCCTGACCCTGGCCAAGAGGG
CACGCGATGAGAGGGAGGTGCCTGTGGGAGCCGTGCTGGTGCTGAACAATAGAGTGATCGGCGAGGGCTG
GAACAGAGCCATCGGCCTGCACGACCCAACAGCCCATGCCGAAATTATGGCCCTGAGACAGGGCGGCCTG
GTCATGCAGAACTACAGACTGATTGACGCCACCCTGTACGTGACATTCGAGCCTTGCGTGATGTGCGCCG
GCGCCATGATCCACTCTAGGATCGGCCGCGTGGTGTTTGGCGTGAGGAACGCAAAAACCGGCGCCGCAGG
CTCCCTGATGGACGTGCTGCACTACCCCGGCATGAATCACCGCGTCGAAATTACCGAGGGAATCCTGGCA
GATGAATGTGCCGCCCTGCTGTGCTATTTCTTTCGGATGCCTAGACAGGTGTTCAATGCTCAGAAGAAGG
CCCAGAGCTCCACCGACTCCGGAGGATCTAGCGGAGGCTCCTCTGGCTCTGAGACACCTGGCACAAGCGA
GAGCGCAACACCTGAAAGCAGCGGGGCAGCAGCGGGGGGTCAGACAAGAAGTACAGCATCGGCCTGGCC
ATCGGCACCAACTCTGTGGGCTGGGCCGTGATCACCGACGAGTACAAGGTGCCCAGCAAGAAATTCAAGG
TGCTGGGCAACACCGACCGGCACAGCATCAAGAAGAACCTGATCGGAGCCCTGCTGTTCGACAGCGGCGA
AACAGCCGAGGCCACCCGGCTGAAGAGAACCGCCAGAAGAAGATACACCAGACGGAAGAACCGGATCTGC
TATCTGCAAGAGATCTTCAGCAACGAGATGGCCAAGGTGGACGACAGCTTCTTCCACAGACTGGAAGAGT
CCTTCCTGGTGGAAGAGGATAAGAAGCACGAGCGGCACCCCATCTTCGGCAACATCGTGGACGAGGTGGC
CTACCACGAGAAGTACCCCACCATCTACCACCTGAGAAAGAAACTGGTGGACAGCACCGACAAGGCCGAC
CTGCGGCTGATCTATCTGGCCCTGGCCCACATGATCAAGTTCCGGGGCCACTTCCTGATCGAGGGCGACC
TGAACCCCGACAACAGCGACGTGGACAAGCTGTTCATCCAGCTGGTGCAGACCTACAACCAGCTGTTCGA
GGAAAACCCCATCAACGCCAGCGGCGTGGACGCCAAGGCCATCCTGTCTGCCAGACTGAGCAAGAGCAGA
CGGCTGGAAAATCTGATCGCCCAGCTGCCCGGCGAGAAGAAGAATGGCCTGTTCGGAAACCTGATTGCCC
```

-continued

```
TGAGCCTGGGCCTGACCCCCAACTTCAAGAGCAACTTCGACCTGGCCGAGGATGCCAAACTGCAGCTGAG

CAAGGACACCTACGACGACGACCTGGACAACCTGCTGGCCCAGATCGGCGACCAGTACGCCGACCTGTTT

CTGGCCGCCAAGAACCTGTCCGACGCCATCCTGCTGAGCGACATCCTGAGAGTGAACACCGAGATCACCA

AGGCCCCCCTGAGCGCCTCTATGATCAAGAGATACGACGAGCACCACCAGGACCTGACCCTGCTGAAAGC

TCTCGTGCGGCAGCAGCTGCCTGAGAAGTACAAAGAGATTTTCTTCGACCAGAGCAAGAACGGCTACGCC

GGCTACATTGACGGCGGAGCCAGCCAGGAAGAGTTCTACAAGTTCATCAAGCCCATCCTGGAAAAGATGG

ACGGCACCGAGGAACTGCTCGTGAAGCTGAACAGAGAGGACCTGCTGCGGAAGCAGCGGACCTTCGACAA

CGGCAGCATCCCCCACCAGATCCACCTGGGAGAGCTGCACGCCATTCTGCGGCGGCAGGAAGATTTTTAC

CCATTCCTGAAGGACAACCGGGAAAAGATCGAGAAGATCCTGACCTTCCGCATCCCCTACTACGTGGGCC

CTCTGGCCAGGGGAAACAGCAGATTCGCCTGGATGACCAGAAAGAGCGAGGAAACCATCACCCCCTGGAA

CTTCGAGGAAGTGGTGGACAAGGGCGCTTCCGCCCAGAGCTTCATCGAGCGGATGACCAACTTCGATAAG

AACCTGCCCAACGAGAAGGTGCTGCCCAAGCACAGCCTGCTGTACGAGTACTTCACCGTGTATAACGAGC

TGACCAAAGTGAAATACGTGACCGAGGGAATGAGAAAGCCCGCCTTCCTGAGCGGCGAGCAGAAAAAGGC

CATCGTGGACCTGCTGTTCAAGACCAACCGGAAAGTGACCGTGAAGCAGCTGAAAGAGGACTACTTCAAG

AAAATCGAGTGCTTCGACTCCGTGGAAATCTCCGGCGTGGAAGATCGGTTCAACGCCTCCCTGGGCACAT

ACCACGATCTGCTGAAAATTATCAAGGACAAGGACTTCCTGGACAATGAGGAAAACGAGGACATTCTGGA

AGATATCGTGCTGACCCTGACACTGTTTGAGGACAGAGAGATGATCGAGGAACGGCTGAAAACCTATGCC

CACCTGTTCGACGACAAAGTGATGAAGCAGCTGAAGCGGCGGAGATACACCGGCTGGGGCAGGCTGAGCC

GGAAGCTGATCAACGGCATCCGGGACAAGCAGTCCGGCAAGACAATCCTGGATTTCCTGAAGTCCGACGG

CTTCGCCAACAGAAACTTCATGCAGCTGATCCACGACGACAGCCTGACCTTTAAAGAGGACATCCAGAAA

GCCCAGGTGTCCGGCCAGGGCGATAGCCTGCACGAGCACATTGCCAATCTGGCCGGCAGCCCCGCCATTA

AGAAGGGCATCCTGCAGACAGTGAAGGTGGTGGACGAGCTCGTGAAAGTGATGGGCCGGCACAAGCCCGA

GAACATCGTGATCGAAATGGCCAGAGAGAACCAGACCACCCAGAAGGGACAGAAGAACAGCCGCGAGAGA

ATGAAGCGGATCGAAGAGGGCATCAAAGAGCTGGGCAGCCAGATCCTGAAAGAACACCCCGTGGAAAACA

CCCAGCTGCAGAACGAGAAGCTGTACCTGTACTACCTGCAGAATGGGCGGGATATGTACGTGGACCAGGA

ACTGGACATCAACCGGCTGTCCGACTACGATGTGGACCATATCGTGCCTCAGAGCTTTCTGAAGGACGAC

TCCATCGACAACAAGGTGCTGACCAGAAGCGACAAGAACCGGGGCAAGAGCGACAACGTGCCCTCCGAAG

AGGTCGTGAAGAAGATGAAGAACTACTGGCGGCAGCTGCTGAACGCCAAGCTGATTACCCAGAGAAAGTT

CGACAATCTGACCAAGGCCGAGAGAGGCGGCCTGAGCGAACTGGATAAGGCCGGCTTCATCAAGAGACAG

CTGGTGGAAACCCGGCAGATCACAAAGCACGTGGCACAGATCCTGGACTCCCGGATGAACACTAAGTACG

ACGAGAATGACAAGCTGATCCGGGAAGTGAAAGTGATCACCCTGAAGTCCAAGCTGGTGTCCGATTTCCG

GAAGGATTTCCAGTTTTACAAAGTGCGCGAGATCAACAACTACCACCACGCCCACGACGCCTACCTGAAC

GCCGTCGTGGGAACCGCCCTGATCAAAAAGTACCCTAAGCTGGAAAGCGAGTTCGTGTACGGCGACTACA

AGGTGTACGACGTGCGGAAGATGATCGCCAAGAGCGAGCAGGAAATCGGCAAGGCTACCGCCAAGTACTT

CTTCTACAGCAACATCATGAACTTTTTCAAGACCGAGATTACCCTGGCCAACGGCGAGATCCGGAAGCGG

CCTCTGATCGAGACAAACGGCGAAACCGGGGAGATCGTGTGGGATAAGGGCCGGGATTTTGCCACCGTGC

GGAAAGTGCTGAGCATGCCCCAAGTGAATATCGTGAAAAAGACCGAGGTGCAGACAGGCGGCTTCAGCAA

AGAGTCTATCCTGCCCAAGAGGAACAGCGATAAGCTGATCGCCAGAAAGAAGGACTGGGACCCTAAGAAG

TACGGCGGCTTCGACAGCCCCACCGTGGCCTATTCTGTGCTGGTGGTGGCCAAAGTGGAAAAGGGCAAGT

CCAAGAAACTGAAGAGTGTGAAAGAGCTGCTGGGGATCACCATCATGGAAAGAAGCAGCTTCGAGAAGAA
```

-continued

```
TCCCATCGACTTTCTGGAAGCCAAGGGCTACAAAGAAGTGAAAAAGGACCTGATCATCAAGCTGCCTAAG

TACTCCCTGTTCGAGCTGGAAAACGGCCGGAAGAGAATGCTGGCCTCTGCCGGCGAACTGCAGAAGGGAA

ACGAACTGGCCCTGCCCTCCAAATATGTGAACTTCCTGTACCTGGCCAGCCACTATGAGAAGCTGAAGGG

CTCCCCCGAGGATAATGAGCAGAAACAGCTGTTTGTGGAACAGCACAAGCACTACCTGGACGAGATCATC

GAGCAGATCAGCGAGTTCTCCAAGAGAGTGATCCTGGCCGACGCTAATCTGGACAAAGTGCTGTCCGCCT

ACAACAAGCACCGGGATAAGCCCATCAGAGAGCAGGCCGAGAATATCATCCACCTGTTTACCCTGACCAA

TCTGGGAGCCCCTGCCGCCTTCAAGTACTTTGACACCACCATCGACCGGAAGAGGTACACCAGCACCAAA

GAGGTGCTGGACGCCACCCTGATCCACCAGAGCATCACCGGCCTGTACGAGACACGGATCGACCTGTCTC

AGCTGGGAGGTGACTCTGGCGGCTCAAAAAGAACCGCCGACGGCAGCGAATTCGAGCCCAAGAAGAAGAG

GAAAGTCTAACCGGTCATCATCACCATCACCATTGAGTTTAAACCCGCTGATCAGCCTCGACTGTGCCTT

CTAGTTGCCAGCCATCTGTTGTTTGCCCCTCCCCCGTGCCTTCCTTGACCCTGGAAGGTGCCACTCCCAC

TGTCCTTTCCTAATAAAATGAGGAAATTGCATCGCATTGTCTGAGTAGGTGTCATTCTATTCTGGGGGGT

GGGGTGGGGCAGGACAGCAAGGGGGAGGATTGGGAAGACAATAGCAGGCATGCTGGGGATGCGGTGGGCT

CTATGGCTTCTGAGGCGGAAAGAACCAGCTGGGGCTCGATACCGTCGACCTCTAGCTAGAGCTTGGCGTA

ATCATGGTCATAGCTGTTTCCTGTGTGAAATTGTTATCCGCTCACAATTCCACACAACATACGAGCCGGA

AGCATAAAGTGTAAAGCCTAGGGTGCCTAATGAGTGAGCTAACTCACATTAATTGCGTTGCGCTCACTGC

CCGCTTTCCAGTCGGGAAACCTGTCGTGCCAGCTGCATTAATGAATCGGCCAACGCGCGGGGAGAGGCGG

TTTGCGTATTGGGCGCTCTTCCGCTTCCTCGCTCACTGACTCGCTGCGCTCGGTCGTTCGGCTGCGGCGA

GCGGTATCAGCTCACTCAAAGGCGGTAATACGGTTATCCACAGAATCAGGGGATAACGCAGGAAAGAACA

TGTGAGCAAAAGGCCAGCAAAAGGCCAGGAACCGTAAAAAGGCCGCGTTGCTGGCGTTTTTCCATAGGCT

CCGCCCCCCTGACGAGCATCACAAAAATCGACGCTCAAGTCAGAGGTGGCGAAACCCGACAGGACTATAA

AGATACCAGGCGTTTCCCCCTGGAAGCTCCCTCGTGCGCTCTCCTGTTCCGACCCTGCCGCTTACCGGAT

ACCTGTCCGCCTTTCTCCCTTCGGGAAGCGTGGCGCTTTCTCATAGCTCACGCTGTAGGTATCTCAGTTC

GGTGTAGGTCGTTCGCTCCAAGCTGGGCTGTGTGCACGAACCCCCCGTTCAGCCCGACCGCTGCGCCTTA

TCCGGTAACTATCGTCTTGAGTCCAACCCGGTAAGACACGACTTATCGCCACTGGCAGCAGCCACTGGTA

ACAGGATTAGCAGAGCGAGGTATGTAGGCGGTGCTACAGAGTTCTTGAAGTGGTGGCCTAACTACGGCTA

CACTAGAAGAACAGTATTTGGTATCTGCGCTCTGCTGAAGCCAGTTACCTTCGGAAAAAGAGTTGGTAGC

TCTTGATCCGGCAAACAAACCACCGCTGGTAGCGGTGGTTTTTTTGTTTGCAAGCAGCAGATTACGCGCA

GAAAAAAAGGATCTCAAGAAGATCCTTTGATCTTTTCTACGGGGTCTGACACTCAGTGGAACGAAAACTC

ACGTTAAGGGATTTTGGTCATGAGATTATCAAAAAGGATCTTCACCTAGATCCTTTTAAATTAAAAATGA

AGTTTTAAATCAATCTAAAGTATATATGAGTAAACTTGGTCTGACAGTTACCAATGCTTAATCAGTGAGG

CACCTATCTCAGCGATCTGTCTATTTCGTTCATCCATAGTTGCCTGACTCCCCGTCGTGTAGATAACTAC

GATACGGGAGGGCTTACCATCTGGCCCCAGTGCTGCAATGATACCGCGAGACCCACGCTCACCGGCTCCA

GATTTATCAGCAATAAACCAGCCAGCCGGAAGGGCCGAGCGCAGAAGTGGTCCTGCAACTTTATCCGCCT

CCATCCAGTCTATTAATTGTTGCCGGGAAGCTAGAGTAAGTAGTTCGCCAGTTAATAGTTTGCGCAACGT

TGTTGCCATTGCTACAGGCATCGTGGTGTCACGCTCGTCGTTTGGTATGGCTTCATTCAGCTCCGGTTCC

CAACGATCAAGGCGAGTTACATGATCCCCCATGTTGTGCAAAAAAGCGGTTAGCTCCTTCGGTCCTCCGA

TCGTTGTCAGAAGTAAGTTGGCCGCAGTGTTATCACTCATGGTTATGGCAGCACTGCATAATTCTCTTAC

TGTCATGCCATCCGTAAGATGCTTTTCTGTGACTGGTGAGTACTCAACCAAGTCATTCTGAGAATAGTGT

ATGCGGCGACCGAGTTGCTCTTGCCCGGCGTCAATACGGGATAATACCGCGCCACATAGCAGAACTTTAA

AAGTGCTCATCATTGGAAAACGTTCTTCGGGGCGAAAACTCTCAAGGATCTTACCGCTGTTGAGATCCAG
```

```
                                        -continued
TTCGATGTAACCCACTCGTGCACCCAACTGATCTTCAGCATCTTTTACTTTCACCAGCGTTTCTGGGTGA

GCAAAAACAGGAAGGCAAAATGCCGCAAAAAAGGGAATAAGGGCGACACGGAAATGTTGAATACTCATAC

TCTTCCTTTTTCAATATTATTGAAGCATTTATCAGGGTTATTGTCTCATGAGCGGATACATATTTGAATG

TATTTAGAAAAATAAACAAATAGGGGTTCCGCGCACATTTCCCCGAAAAGTGCCACCTGACGTCGACGGA

TCGGGAGATCGATCTCCCGATCCCCTAGGGTCGACTCTCAGTACAATCTGCTCTGATGCCGCATAGTTAA

GCCAGTATCTGCTCCCTGCTTGTGTGTTGGAGGTCGCTGAGTAGTGCGCGAGCAAAATTTAAGCTACAAC

AAGGCAAGGCTTGACCGACAATTGCATGAAGAATCTGCTTAGGGTTAGGCGTTTTGCGCTGCTTCGCGAT

GTACGGGCCAGATATACGCGTTGACATTGATTATTGACTAGTTATTAATAGTAATCAATTACGGGGTCAT

TAGTTCATAGCCCATATATGGAGTTCCGCGTTACATAACTTACGGTAAATGGCCCGCCTGGCTGACCGCC

CAACGACCCCCGCCCATTGACGTCAATAATGACGTATGTTCCCATAGTAACGCCAATAGGGACTTTCCAT

TGACGTCAATGGGTGGAGTATTTACGGTAAACTGCCCACTTGGCAGTACATCAAGTGTATC
(SEQ ID NO: 28)
```

By "base editing activity" is meant acting to chemically alter a base within a polynucleotide. In one embodiment, a first base is converted to a second base. In one embodiment, the base editing activity is cytidine deaminase activity, e.g., converting target C•G to T•A. In another embodiment, the base editing activity is adenosine or adenine deaminase activity, e.g., converting A•T to G•C. In another embodiment, the base editing activity is cytidine deaminase activity, e.g., converting target C•G to T•A and adenosine or adenine deaminase activity, e.g., converting A•T to G•C (see PCT/US2019/044935, PCT/US2020/016288, each of which is incorporated herein by reference for its entirety).

In some embodiments, base editing activity is assessed by efficiency of editing. Base editing efficiency may be measured by any suitable means, for example, by sanger sequencing or next generation sequencing. In some embodiments, base editing efficiency is measured by percentage of total sequencing reads with nucleobase conversion effected by the base editor, for example, percentage of total sequencing reads with target A.T base pair converted to a G.C base pair. In some embodiments, base editing efficiency is measured by percentage of total cells with nucleobase conversion effected by the base editor, when base editing is performed in a population of cells.

The term "base editor system" refers to a system for editing a nucleobase of a target nucleotide sequence. In various embodiments, the base editor system comprises (1) a polynucleotide programmable nucleotide binding domain (e.g. Cas9); (2) a deaminase domain (e.g. an adenosine deaminase and/or cytidine deaminase; see PCT/US2019/044935, PCT/US2020/016288, each of which is incorporated herein by reference for its entirety) for deaminating said nucleobase; and (3) one or more guide polynucleotide (e.g., guide RNA). In some embodiments, the polynucleotide programmable nucleotide binding domain is a polynucleotide programmable DNA binding domain. In some embodiments, the base editor is an adenine or adenosine base editor (ABE). In some embodiments, the base editor system is ABE8.

In some embodiments, a base editor system may comprise more than one base editing component. For example, a base editor system may include more than one deaminase. In some embodiments, a base editor system may include one or more adenosine deaminases. In some embodiments, a single guide polynucleotide may be utilized to target different deaminases to a target nucleic acid sequence. In some embodiments, a single pair of guide polynucleotides may be utilized to target different deaminases to a target nucleic acid sequence.

The deaminase domain and the polynucleotide programmable nucleotide binding component of a base editor system may be associated with each other covalently or non-covalently, or any combination of associations and interactions thereof. For example, in some embodiments, a deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the deaminase domain can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the deaminase domain can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a BER inhibitor. In some embodiments, the inhibitor of BER can be a uracil DNA glycosylase inhibitor (UGI). In some embodiments, the inhibitor of BER can be an inosine BER inhibitor. In some embodiments, the inhibitor of BER can be targeted to the target nucleotide sequence by the polynucleotide programmable nucleotide binding domain. In some embodiments, a polynucleotide programmable nucleotide binding domain can be fused or linked to an inhibitor of BER. In some embodiments, a polynucleotide programmable nucleotide binding domain can be fused or linked to a deaminase domain and an inhibitor of BER. In some embodiments, a polynucleotide programmable nucleotide binding domain can target an inhibitor of BER to a target nucleotide sequence by non-covalently interacting with or associating with the inhibitor of BER. For example, in some embodiments, the inhibitor of BER component can comprise an additional heterologous portion or domain that is capable of interacting with, associating with, or capable of forming a complex with an additional heterologous portion or domain that is part of a polynucleotide programmable nucleotide binding domain.

In some embodiments, the inhibitor of BER can be targeted to the target nucleotide sequence by the guide polynucleotide. For example, in some embodiments, the inhibitor of BER can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of BER. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

The term "Cas9" or "Cas9 domain" refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a Casn1 nuclease or a CRISPR (clustered regularly interspaced short palindromic repeat) associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

An exemplary Cas9, is *Streptococcus pyogenes* Cas9 (spCas9), the amino acid sequence of which is provided below:

MDKK<u>YSIGLDIGTNSVGWAVITDDYKVPSKKFKVLGNTDRHSIKKNLIG

ALLFGSGETA</u>EATRLKRTARRRYTRRKNRICYLQEIFSNEMAKVDDSFF

HRLEESFLVEEDKKHERHPIFGNIVDEVAYHEKYPTIYHLRKKLADSTD

KADLRLIYLALAHMIKFRGHFLIEGDLNPDNSDVDKLFIQLVQIYNQLF

EENPINASRVDAKAILSARLSKSRRLENLIAQLPGEKRNGLFGNLIALS

LGLTPNFKSNFDLAEDAKLQLSKDTYDDDLDNLLAQIGDQYADLFLAAK

NLSDAILLSDILRVNSEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGAYHDLLKIIKDKDFLDNEENEDILEDIVLTLTLFEDRGMIEERLK

TYAHLFDDKVMKQLKRRRYTGWGRLSRKLINGIRDKQSGKTILDFLKSD

GFANRNFMQLIHDDSLTFKEDIQKAQVSGQG<u>HSLHEQIANLAGSPAIKK

GILQTVKIVDELVKVMGHKPENIVIEMARE</u>NQTTQKG<u>QKNSRERMKRIE

EGIKELGSQILKEHPVENTQLQNEKLYLYYLQNGRDMYVDQELDINRLS

DYDVDHIVPQSFIKDDSIDNKVLTRSDKNRGKSDNVPSEEVVKKMKNYW

RQLLNAKLITQRKFDNLTKAERGG</u>LSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD (SEQ ID NO: 29)
(single underline: HNH domain; double underline: RuvC domain)

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)). In some embodiments, a Cas9 nuclease has an inactive (e.g., an inactivated) DNA cleavage domain, that is, the Cas9 is a nickase, referred to as an "nCas9" protein (for "nickase" Cas9). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, wild-type Cas9 corresponds to Cas9 from *Streptococcus pyogenes* (NCBI Reference Sequence: NC_017053.1, nucleotide and amino acid sequences as follows).

ATGGATAAGAAATACTCAATAGGCTTAGATATCGGCACAAATAGCGTCGGATGGGCGGTGAT
CACTGATGATTATAAGGTTCCGTCTAAAAAGTTCAAGGTTCTGGGAAATACAGACCGCCACA
GTATCAAAAAAAATCTTATAGGGGCTCTTTTATTTGGCAGTGGAGAGACAGCGGAAGCGACT
CGTCTCAAACGGACAGCTCGTAGAAGGTATACACGTCGGAAGAATCGTATTTGTTATCTACA
GGAGATTTTTTCAAATGAGATGGCGAAAGTAGATGATAGTTTCTTTCATCGACTTGAAGAGT
CTTTTTTGGTGGAAGAAGACAAGAAGCATGAACGTCATCCTATTTTTGGAAATATAGTAGAT
GAAGTTGCTTATCATGAGAAATATCCAACTATCTATCATCTGCGAAAAAAATTGGCAGATTC
TACTGATAAAGCGGATTTGCGCTTAATCTATTTGGCCTTAGCGCATATGATTAAGTTTCGTG
GTCATTTTTTGATTGAGGGAGATTTAAATCCTGATAATAGTGATGTGGACAAACTATTTATC
CAGTTGGTACAAATCTACAATCAATTATTTGAAGAAAACCCTATTAACGCAAGTAGAGTAGA
TGCTAAAGCGATTCTTTCTGCACGATTGAGTAAATCAAGACGATTAGAAAATCTCATTGCTC
AGCTCCCCGGTGAGAAGAGAAATGGCTTGTTTGGGAATCTCATTGCTTTGTCATTGGGATTG
ACCCCTAATTTTAAATCAAATTTTGATTTGGCAGAAGATGCTAAATTACAGCTTTCAAAAGA
TACTTACGATGATGATTTAGATAATTTATTGGCGCAAATTGGAGATCAATATGCTGATTTGT
TTTTGGCAGCTAAGAATTTATCAGATGCTATTTTACTTTCAGATATCCTAAGAGTAAATAGT
GAAATAACTAAGGCTCCCCTATCAGCTTCAATGATTAAGCGCTACGATGAACATCATCAAGA
CTTGACTCTTTTAAAAGCTTTAGTTCGACAACAACTTCCAGAAAAGTATAAAGAAATCTTTT
TTGATCAATCAAAAAACGGATATGCAGGTTATATTGATGGGGAGCTAGCCAAGAAGAATTT
TATAAATTTATCAAACCAATTTTAGAAAAAATGGATGGTACTGAGGAATTATTGGTGAAACT
AAATCGTGAAGATTTGCTGCGCAAGCAACGGACCTTTGACAACGGCTCTATTCCCCATCAAA
TTCACTTGGGTGAGCTGCATGCTATTTTGAGAAGACAAGAAGACTTTTATCCATTTTTAAAA
GACAATCGTGAGAAGATTGAAAAAATCTTGACTTTTCGAATTCCTTATTATGTTGGTCCATT
GGCGCGTGGCAATAGTCGTTTTGCATGGATGACTCGGAAGTCTGAAGAAACAATTACCCCAT
GGAATTTTGAAGAAGTTGTCGATAAAGGTGCTTCAGCTCAATCATTTATTGAACGCATGACA
AACTTTGATAAAAATCTTCCAAATGAAAAAGTACTACCAAAACATAGTTTGCTTTATGAGTA
TTTTACGGTTTATAACGAATTGACAAAGGTCAAATATGTTACTGAGGGAATGCGAAAACCAG
CATTTCTTTCAGGTGAACAGAAGAAAGCCATTGTTGATTTACTCTTCAAAACAAATCGAAAA
GTAACCGTTAAGCAATTAAAAGAAGATTATTTCAAAAAAATAGAATGTTTTGATAGTGTTGA
AATTTCAGGAGTTGAAGATAGATTTAATGCTTCATTAGGCGCCTACCATGATTTGCTAAAAA
TTATTAAAGATAAAGATTTTTTGGATAATGAAGAAATGAAGATATCTTAGAGGATATTGTT
TTAACATTGACCTTATTTGAAGATAGGGGGATGATTGAGGAAAGACTTAAAACATATGCTCA
CCTCTTTGATGATAAGGTGATGAAACAGCTTAAACGTCGCCGTTATACTGGTTGGGGACGTT
TGTCTCGAAAATTGATTAATGGTATTAGGGATAAGCAATCTGGCAAAACAATATTAGATTTT
TTGAAATCAGATGGTTTTGCCAATCGCAATTTTATGCAGCTGATCCATGATGATAGTTTGAC
ATTTAAAGAAGATATTCAAAAAGCACAGGTGTCTGGACAAGGCCATAGTTTACATGAACAGA
TTGCTAACTTAGCTGGCAGTCCTGCTATTAAAAAAGGTATTTTACAGACTGTAAAAATTGTT
GATGAACTGGTCAAAGTAATGGGGCATAAGCCAGAAAATATCGTTATTGAAATGGCACGTGA
AAATCAGACAACTCAAAAGGGCCAGAAAAATTCGCGAGAGCGTATGAAACGAATCGAAGAAG
GTATCAAAGAATTAGGAAGTCAGATTCTTAAAGAGCATCCTGTTGAAAATACTCAATTGCAA
AATGAAAAGCTCTATCTCTATTATCTACAAAATGGAAGAGACATGTATGTGGACCAAGAATT
AGATATTAATCGTTTAAGTGATTATGATGTCGATCACATTGTTCCACAAAGTTTCATTAAAG

```
ACGATTCAATAGACAATAAGGTACTAACGCGTTCTGATAAAAATCGTGGTAAATCGGATAAC
GTTCCAAGTGAAGAAGTAGTCAAAAAGATGAAAAACTATTGGAGACAACTTCTAAACGCCAA
GTTAATCACTCAACGTAAGTTTGATAATTTAACGAAAGCTGAACGTGGAGGTTTGAGTGAAC
TTGATAAAGCTGGTTTTATCAAACGCCAATTGGTTGAAACTCGCCAAATCACTAAGCATGTG
GCACAAATTTTGGATAGTCGCATGAATACTAAATACGATGAAAATGATAAACTTATTCGAGA
GGGTTAAAGTGATTACCTTAAAATCTAAATTAGTTTCTGACTTCCGAAAAGATTTCCAATTCT
ATAAAGTACGTGAGATTAACAATTACCATCATGCCCATGATGCGTATCTAAATGCCGTCGTT
GGAACTGCTTTGATTAAGAAATATCCAAAACTTGAATCGGAGTTTGTCTATGGTGATTATAA
AGTTTATGATGTTCGTAAAATGATTGCTAAGTCTGAGCAAGAAATAGGCAAAGCAACCGCAA
AATATTTCTTTTACTCTAATATCATGAACTTCTTCAAAACAGAAATTACACTTGCAAATGGA
GAGATTCGCAAACGCCCTCTAATCGAAACTAATGGGGAAACTGGAGAAATTGTCTGGGATAA
AGGGCGAGATTTTGCCACAGTGCGCAAAGTATTGTCCATGCCCCAAGTCAATATTGTCAAGA
AAACAGAAGTACAGACAGGCGGATTCTCCAAGGAGTCAATTTTACCAAAAAGAAATTCGGAC
AAGCTTATTGCTCGTAAAAAAGACTGGGATCCAAAAAAATATGGTGGTTTTGATAGTCCAAC
GGTAGCTTATTCAGTCCTAGTGGTTGCTAAGGTGGAAAAAGGGAAATCGAAGAAGTTAAAAT
CCGTTAAAGAGTTACTAGGGATCACAATTATGGAAAGAAGTTCCTTTGAAAAAAATCCGATT
GACTTTTTAGAAGCTAAAGGATATAAGGAAGTTAAAAAAGACTTAATCATTAAACTACCTAA
ATATAGTCTTTTTGAGTTAGAAAACGGTCGTAAACGGATGCTGGCTAGTGCCGGAGAATTAC
AAAAAGGAAATGAGCTGGCTCTGCCAAGCAAATATGTGAATTTTTTATATTTAGCTAGTCAT
TATGAAAAGTTGAAGGGTAGTCCAGAAGATAACGAACAAAAACAATTGTTTGTGGAGCAGCA
TAAGCATTATTTAGATGAGATTATTGAGCAAATCAGTGAATTTTCTAAGCGTGTTATTTTAG
CAGATGCCAATTTAGATAAAGTTCTTAGTGCATATAACAAACATAGAGACAAACCAATACGT
GAACAAGCAGAAAATATTATTCATTTATTTACGTTGACGAATCTTGGAGCTCCCGCTGCTTT
TAAATATTTTGATACAACAATTGATCGTAAACGATATACGTCTACAAAAGAAGTTTTAGATG
CCACTCTTATCCATCAATCCATCACTGGTCTTTATGAAACACGCATTGATTTGAGTCAGCTA
GGAGGTGACTGA (SEQ ID NO: 30)

MDKKYSIGLDIGTNSVGWAVITDDYKVPSKKFKVLGNTDRHSIKKNLIGALLFGSGETAEAT
RLKRTARRRYTRRKNRICYLQEIFSNEMAKVDDSFFHRLEESFLVEEDKKHERHPIFGNIVD
EVAYHEKYPTIYHLRKKLADSTDKADLRLIYLALAHMIKFRGHFLIEGDLNPDNSDVDKLFI
QLVQIYNQLFEENPINASRVDAKAILSARLSKSRRLENLIAQLPGEKRNGLFGNLIALSLGL
TPNFKSNFDLAEDAKLQLSKDTYDDDLDNLLAQIGDQYADLFLAAKNLSDAILLSDILRVNS
EITKAPLSASMIKRYDEHHQDLTLLKALVRQQLPEKYKEIFFDQSKNGYAGYIDGGASQEEF
YKFIKPILEKMDGTEELLVKLNREDLLRKQRTFDNGSIPHQIHLGELHAILRRQEDFYPFLK
DNREKIEKILTFRIPYYVGPLARGNSRFAWMTRKSEETITPWNFEEVVDKGASAQSFIERMT
NFDKNLPNEKVLPKHSLLYEYFTVYNELTKVKYVTEGMRKPAFLSGEQKKAIVDLLFKTNRK
VTVKQLKEDYFKKIECFDSVEISGVEDRFNASLGAYHDLLKIIKDKDFLDNEENEDILEDIV
LTLTLFEDRGMIEERLKTYAHLFDDKVMKQLKRRRYTGWGRLSRKLINGIRDKQSGKTILDF
LKSDGFANRNFMQLIHDDSLTFKEDIQKAQVSGQGHSLHEQIANLAGSPAIKKGILQTVKIV
DELVKVMGHKPENIVIEMARENQTTQKGQKNSRERMKRIEEGIKELGSQILKEHPVENTQLQ
NEKLYLYYLQNGRDMYVDQELDINRLSDYDVDHIVPQSFIKDDSIDNKVLTRSDKNRGKSDN
```

-continued

<u>VPSEEVVKKMKNYWRQLLNAKLITQRKFDNLTKAERG</u><u>GLSELDKAGFIKRQLVETRQITKHV</u>

<u>AQILDSRMNTKYDENDKLIREVKVITLKSKLVSDFRKDFQFYKVREINNYHHAHDAYLNAVV</u>

<u>GTALIKKYPKLESEFVYGDYKVYDVRKMIAKSEQEIGKATAKYFFYSNIMNFFKTEITLANG</u>

<u>EIRKRPLIETNGETGEIVWDKGRDFATVRKVLSMPQVNIVKKTEVQT</u>GGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD (SEQ ID NO: 29)
(single underline: HNH domain; double underline: RuvC domain)

In some embodiments, wild-type Cas9 corresponds to, or comprises the following nucleotide and/or amino acid sequences:

ATGGATAAAAAGTATTCTATTGGTTTAGACATCGGCACTAATTCCGTTGGATGGGCTGTCAT

AACCGAGGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

CCTTCCTTGTCGAAGAGGACAAGAAACATGAACGGCACCCCATCTTTGGAAACATAGTAGAT

GAGGTGGCATATCATGAAAAGTACCCAACGATTTATCACCTCAGAAAAAAGCTAGTTGACTC

AACTGACAAAGCGGACCTGAGGTTAATCTACTTGGCTCTTGCCCATATGATAAAGTTCCGTG

GGCACTTTCTCATTGAGGGTGATCTAAATCCGGACAACTCGGATGTCGACAAACTGTTCATC

CAGTTAGTACAAACCTATAATCAGTTGTTTGAAGAGAACCCTATAAATGCAAGTGGCGTGGA

TGCGAAGGCTATTCTTAGCGCCCGCCTCTCTAAATCCCGACGGCTAGAAAACCTGATCGCAC

AATTACCCGGAGAGAAGAAAAATGGGTTGTTCGGTAACCTTATAGCGCTCTCACTAGGCCTG

ACACCAAATTTTAAGTCGAACTTCGACTTAGCTGAAGATGCCAAATTGCAGCTTAGTAAGGA

CACGTACGATGACGATCTCGACAATCTACTGGCACAAATTGGAGATCAGTATGCGGACTTAT

TTTTGGCTGCCAAAAACCTTAGCGATGCAATCCTCCTATCTGACATACTGAGAGTTAATACT

GAGATTACCAAGGCGCCGTTATCCGCTTCAATGATCAAAAGGTACGATGAACATCACCAAGA

CTTGACACTTCTCAAGGCCCTAGTCCGTCAGCAACTGCCTGAGAAATATAAGGAAATATTCT

TTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACT

CAATCGCGAAGATCTACTGCGAAAGCAGCGGACTTTCGACAACGGTAGCATTCCACATCAAA

TCCACTTAGGCGAATTGCATGCTATACTTAGAAGGCAGGAGGATTTTTATCCGTTCCTCAAA

GACAATCGTGAAAAGATTGAGAAAATCCTAACCTTTCGCATACCTTACTATGTGGGACCCCT

GGCCCGAGGGAACTCTCGGTTCGCATGGATGACAAGAAAGTCCGAAGAAACGATTACTCCAT

GGAATTTTGAGGAAGTTGTCGATAAAGGTGCGTCAGCTCAATCGTTCATCGAGAGGATGACC

AACTTTGACAAGAATTTACCGAACGAAAAGTATTGCCTAAGCACAGTTTACTTTACGAGTA

TTTCACAGTGTACAATGAACTCACGAAAGTTAAGTATGTCACTGAGGGCATGCGTAAACCCG

CCTTTCTAAGCGGAGAACAGAAGAAAGCAATAGTAGATCTGTTATTCAAGACCAACCGCAAA

GTGACAGTTAAGCAATTGAAAGAGGACTACTTTAAGAAAATTGAATGCTTCGATTCTGTCGA

-continued

```
GATCTCCGGGGTAGAAGATCGATTTAATGCGTCACTTGGTACGTATCATGACCTCCTAAAGA
TAATTAAAGATAAGGACTTCCTGGATAACGAAGAGAATGAAGATATCTTAGAAGATATAGTG
TTGACTCTTACCCTCTTTGAAGATCGGGAAATGATTGAGGAAAGACTAAAAACATACGCTCA
CCTGTTCGACGATAAGGTTATGAAACAGTTAAAGAGGCGTCGCTATACGGGCTGGGGACGAT
TGTCGCGGAAACTTATCAACGGGATAAGAGACAAGCAAAGTGGTAAAACTATTCTCGATTTT
CTAAAGAGCGACGGCTTCGCCAATAGGAACTTTATGCAGCTGATCCATGATGACTCTTTAAC
CTTCAAAGAGGATATACAAAAGGCACAGGTTTCCGGACAAGGGGACTCATTGCACGAACATA
TTGCGAATCTTGCTGGTTCGCCAGCCATCAAAAAGGGCATACTCCAGACAGTCAAAGTAGTG
GATGAGCTAGTTAAGGTCATGGGACGTCACAAACCGGAAAACATTGTAATCGAGATGGCACG
CGAAAATCAAACGACTCAGAAGGGGCAAAAAAACAGTCGAGAGCGGATGAAGAGAATAGAAG
AGGGTATTAAAGAACTGGGCAGCCAGATCTTAAAGGAGCATCCTGTGGAAAATACCCAATTG
CAGAACGAGAAACTTTACCTCTATTACCTACAAAATGGAAGGGACATGTATGTTGATCAGGA
ACTGGACATAAACCGTTTATCTGATTACGACGTCGATCACATTGTACCCCAATCCTTTTTGA
AGGACGATTCAATCGACAATAAAGTGCTTACACGCTCGGATAAGAACCGAGGGAAAAGTGAC
AATGTTCCAAGCGAGGAAGTCGTAAAGAAAATGAAGAACTATTGGCGGCAGCTCCTAAATGC
GAAACTGATAACGCAAAGAAAGTTCGATAACTTAACTAAAGCTGAGAGGGGTGGCTTGTCTG
AACTTGACAAGGCCGGATTTATTAAACGTCAGCTCGTGGAAACCCGCCAAATCACAAAGCAT
GTTGCACAGATACTAGATTCCCGAATGAATACGAAATACGACGAGAACGATAAGCTGATTCG
GGAAGTCAAAGTAATCACTTTAAAGTCAAAATTGGTGTCGGACTTCAGAAAGGATTTTCAAT
TCTATAAAGTTAGGGAGATAAATAACTACCACCATGCGCACGACGCTTATCTTAATGCCGTC
GTAGGGACCGCACTCATTAAGAAATACCCGAAGCTAGAAAGTGAGTTTGTGTATGGTGATTA
CAAAGTTTATGACGTCCGTAAGATGATCGCGAAAAGCGAACAGGAGATAGGCAAGGCTACAG
CCAAATACTTCTTTTATTCTAACATTATGAATTTCTTTAAGACGGAAATCACTCTGGCAAAC
GGAGAGATACGCAAACGACCTTTAATTGAAACCAATGGGGAGACAGGTGAAATCGTATGGGA
TAAGGGCCGGGACTTCGCGACGGTGAGAAAAGTTTTGTCCATGCCCCAAGTCAACATAGTAA
AGAAACTGAGGTGCAGACCGGAGGGTTTTCAAAGGAATCGATTCTTCCAAAAAGGAATAGT
GATAAGCTCATCGCTCGTAAAAAGGACTGGGACCCGAAAAAGTACGGTGGCTTCGATAGCCC
TACAGTTGCCTATTCTGTCCTAGTAGTGGCAAAAGTTGAGAAGGGAAAATCCAAGAAACTGA
AGTCAGTCAAAGAATTATTGGGGATAACGATTATGGAGCGCTCGTCTTTTGAAAAGAACCCC
ATCGACTTCCTTGAGGCGAAAGGTTACAAGGAAGTAAAAAAGGATCTCATAATTAAACTACC
AAAGTATAGTCTGTTTGAGTTAGAAAATGGCCGAAACGGATGTTGGCTAGCGCCGGAGAGC
TTCAAAAGGGGAACGAACTCGCACTACCGTCTAAATACGTGAATTTCCTGTATTTAGCGTCC
CATTACGAGAAGTTGAAAGGTTCACCTGAAGATAACGAACAGAAGCAACTTTTTGTTGAGCA
GCACAAACATTATCTCGACGAAATCATAGAGCAAATTTCGGAATTCAGTAAGAGAGTCATCC
TAGCTGATGCCAATCTGGACAAAGTATTAAGCGCATACAACAAGCACAGGGATAAACCCATA
CGTGAGCAGGCGGAAAATATTATCCATTTGTTTACTCTTACCAACCTCGGCGCTCCAGCCGC
ATTCAAGTATTTTGACACAACGATAGATCGCAAACGATACACTTCTACCAAGGAGGTGCTAG
ACGCGACACTGATTCACCAATCCATCACGGGATTATATGAAACTCGGATAGATTTGTCACAG
CTTGGGGGTGACGGATCCCCCAAGAAGAAGAGGAAAGTCTCGAGCGACTACAAAGACCATGA
CGGTGATTATAAAGATCATGACATCGATTACAAGGATGACGATGACAAGGCTGCAGGA
(SEQ ID NO: 31)
```

MDKK<u>YSIGLAIGTNSVGWAVITDEYKVPSKKFKVLGNTDRHSIKKNLIGALLFDSGETA</u>EAT
RLKRTARRRYTRRKNRICYLQEIFSNEMAKVDDSFFHRLEESFLVEEDKKHERHPIFGNIVD
EVAYHEKYPTIYHLRKKLVDSTDKADLRLIYLALAHMIKFRGHFLIEGDLNPDNSDVDKLFI
QLVQTYNQLFEENPINASGVDAKAILSARLSKSRRLENLIAQLPGEKKNGLFGNLIALSLGL
TPNFKSNFDLAEDAKLQLSKDTYDDDLDNLLAQIGDQYADLFLAAKNLSDAILLSDILRVNT
EITKAPLSASMIKRYDEHHQDLTLLKALVRQQLPEKYKEIFFDQSKNGYAGYIDGGASQEEF
YKFIKPILEKMDGTEELLVKLNREDLLRKQRTFDNGSIPHQIHLGELHAILRRQEDFYPFLK
DNREKIEKILTFRIPYYVGPLARGNSRFAWMTRKSEETITPWNFEEVVDKGASAQSFIERMT
NFDKNLPNEKVLPKHSLLYEYFTVYNELTKVKYVTEGMRKPAFLSGEQKKAIVDLLFKTNRK
VTVKQLKEDYFKKIECFDSVEISGVEDRFNASLGTYHDLLKIIKDKDFLDNEENEDILEDIV
LTLTLFEDREMIEERLKTYAHLFDDKVMKQLKRRRYTGWGRLSRKLINGIRDKQSGKTILDF
LKSDGFANRNFMQLIHDDSLTFKEDIQKAQVSGQG<u>DSLHEHIANLAGSPAIKKGILQTVKVV</u>
<u>DELVKVMGRHKPENIVIEMAR</u>ENQTTQK<u>GQKNSRERMKRIEEGIKELGSQILKEHPVENTQL</u>
<u>QNEKLYLYYLQNGRDMYVDQELDINRLSDYDVDHIVPQSFLKDDSIDNKVLTRSDKNRGKSD</u>
<u>NVPSEEVVKKMKNYWRQLLNAKLITQRKFDNLTKAERG</u>══GLSELDKAGFIKRQLVETRQITKH══
══VAQILDSRMNTKYDENDKLIREVKVITLKSKLVSDFRKDFQFYKVREINNYHHAHDAYLNAV══
══VGTALIKKYPKLESEFVYGDYKVYDVRKMIAKSEQEIGKATAKYFFYSNIMNFFKTEITLAN══
══GEIRKRPLIETNGETGEIVWDKGRDFATVRKVLSMPQVNIVKKTEVQT══GGFSKESILPKRNS
DKLIARKKDWDPKKYGGFDSPTVAYSVLVVAKVEKGKSKKLKSVKELLGITIMERSSFEKNP
IDFLEAKGYKEVKKDLIIKLPKYSLFELENGRKRMLASAGELQKGNELALPSKYVNFLYLAS
HYEKLKGSPEDNEQKQLFVEQHKHYLDEIIEQISEFSKRVILADANLDKVLSAYNKHRDKPI
REQAENIIHLFTLTNLGAPAAFKYFDTTIDRKRYTSTKEVLDATLIHQSITGLYETRIDLSQ
LGGD (SEQ ID NO: 32)
(single underline: HNH domain; double underline: RuvC domain)

40

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows).

ATGGATAAGAAATACTCAATAGGCTTAGATATCGGCACAAATAGCGTCGGATGGGCGGTGAT
CACTGATGAATATAAGGTTCCGTCTAAAAAGTTCAAGGTTCTGGGAAATACAGACCGCCACA
GTATCAAAAAAAATCTTATAGGGGCTCTTTTATTTGACAGTGGAGAGACAGCGGAAGCGACT
CGTCTCAAACGGACAGCTCGTAGAAGGTATACACGTCGGAAGAATCGTATTTGTTATCTACA
GGAGATTTTTTCAAATGAGATGGCGAAAGTAGATGATAGTTTCTTTCATCGACTTGAAGAGT
CTTTTTTGGTGGAAGAAGACAAGAAGCATGAACGTCATCCTATTTTTGGAAATATAGTAGAT
GAAGTTGCTTATCATGAGAAATATCCAACTATCTATCATCTGCGAAAAAAATTGGTAGATTC
TACTGATAAAGCGGATTTGCGCTTAATCTATTTGGCCTTAGCGCATATGATTAAGTTTCGTG
GTCATtTTTTGATTGAGGGAGATTTAAATCCTGATAATAGTGATGTGGACAAACTATTTATC
CAGTTGGTACAAACCTACAATCAATTATTTGAAGAAAACCCTATTAACGCAAGTGGAGTAGA
TGCTAAAGCGATTCTTTCTGCACGATTGAGTAAATCAAGACGATTAGAAAATCTCATTGCTC
AGCTCCCCGGTGAGAAGAAAAATGGCTTATTTGGGAATCTCATTGCTTTGTCATTGGGTTTG

-continued

```
ACCCCTAATTTTAAATCAAATTTTGATTTGGCAGAAGATGCTAAATTACAGCTTTCAAAGA

TACTTACGATGATGATTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGAGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA
```

-continued

```
AGAAAACAGAAGTACAGACAGGCGGATTCTCCAAGGAGTCAATTTTACCAAAAAGAAATTCG

GACAAGCTTATTGCTCGTAAAAAAGACTGGGATCCAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAAGAAGTTCCTTTGAAAAAAATCCG

ATTGACTTTTTAGAAGCTAAAGGATATAAGGAAGTTAAAAAAGACTTAATCATTAAACTACC

TAAATATAGTCTTTTTGAGTTAGAAAACGGTCGTAAACGGATGCTGGCTAGTGCCGGAGAAT

TACAAAAAGGAAATGAGCTGGCTCTGCCAAGCAAATATGTGAATTTTTTATATTTAGCTAGT

CATTATGAAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA (SEQ ID NO: 33)
```

MDKK<u>YSIGLDIGTNSVGWAVITDEYKVPSKKFKVLGNTDRHSIKKNLIGALLFDSGETAEAT</u>
RLKRTARRRYTRRKNRICYLQEIFSNEMAKVDDSFFHRLEESFLVEEDKKHERHPIFGNIVD
EVAYHEKYPTIYHLRKKLVDSTDKADLRLIYLALAHMIKFRGHFLIEGDLNPDNSDVDKLFI
QLVQTYNQLFEENPINASGVDAKAILSARLSKSRRLENLIAQLPGEKKNGLFGNLIALSLGL
TPNFKSNFDLAEDAKLQLSKDTYDDDLDNLLAQIGDQYADLFLAAKNLSDAILLSDILRVNT
EITKAPLSASMIKRYDEHHQDLTLLKALVRQQLPEKYKEIFFDQSKNGYAGYIDGGASQEEF
YKFIKPILEKMDGTEELLVKLNREDLLRKQRTFDNGSIPHQIHLGELHAILRRQEDFYPFLK
DNREKIEKILTFRIPYYVGPLARGNSRFAWMTRKSEETITPWNFEEVVDKGASAQSFIERMT
NFDKNLPNEKVLPKHSLLYEYFTVYNELTKVKYVTEGMRKPAFLSGEQKKAIVDLLFKTNRK
VTVKQLKEDYFKKIECFDSVEISGVEDRFNASLGTYHDLLKIIKDKDFLDNEENEDILEDIV
LTLTLFEDREMIEERLKTYAHLFDDKVMKQLKRRRYTGWGRLSRKLINGIRDKQSGKTILDF
LKSDGFANRNFMQLIHDDSLTFKEDIQKAQVSGQG<u><u>DSLHEHIANLAGSPAIKKGILQTVKVV
DELVKVMGRHKPENIVIEMAR</u></u>ENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDKNRGKSD
NVPSEEVVKKMKNYWRQLLNAKLITQRKFDNLTKAERG<u><u>GLSELDKAGFIKRQLVETRQITKH
VAQILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQT</u></u>GGFSKESILPKRNS
DKLIARKKDWDPKKYGGFDSPTVAYSVLVVAKVEKGKSKKLKSVKELLGITIMERSSFEKNP
IDFLEAKGYKEVKKDLIIKLPKYSLFELENGRKRMLASAGELQKGNELALPSKYVNFLYLAS
HYEKLKGSPEDNEQKQLFVEQHKHYLDEIIEQISEFSKRVILADANLDKVLSAYNKHRDKPI
REQAENIIHLFTLTNLGAPAAFKYFDTTIDRKRYTSTKEVLDATLIHQSITGLYETRIDLSQ
LGGD
(SEQ ID NO: 1; single underline: HNH domain;
double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref:

NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

In some embodiments, the Cas9 is from *Neisseria meningitidis* (Nme). In some embodiments, the Cas9 is Nme1, Nme2 or Nme3. In some embodiments, the PAM-interacting domains for Nme1, Nme2 or Nme3 are N$_4$GAT, N$_4$CC, and N$_4$CAAA, respectively (see e.g., Edraki, A., et al., A Compact, High-Accuracy Cas9 with a Dinucleotide PAM for In Vivo Genome Editing, Molecular Cell (2018)). An exemplary *Neisseria meningitidis* Cas9 protein, Nme1Cas9, (NCBI Reference: WP_002235162.1; type II CRISPR RNA-guided endonuclease Cas9) has the following amino acid sequence:

```
  1 maafkpnpin yilgldigia svgwamveid
    edenpiclid lgvrvferae vpktgdslam
 61 arrlarsvrr ltrrrahrll rarrllkreg
    vlqaadfden glikslpntp wqlraaaldr
121 kltplewsav llhlikhrgy lsqrkneget
    adkelgallk gvadnahalq tgdfrtpael
181 alnkfekesg hirnqrgdys htfsrkdlqa
    elilllfekqk efgnphvsgg lkegietllm
241 tqrpalsgda vqkmlghctf epaepkaakn
    tytaerfiwl tklnnlrile qgserpltdt
301 eratlmdepy rkskltyaqa rkllgledta
    ffkglrygkd naeastlmem kayhaisral
361 ekeglkdkks pinlspelqd eigtafslfk
    tdeditgrlk driqpeilea llkhisfdkf
421 vqislkalrr ivplmeqgkr ydeacaeiyg
    dhygkkntee kiylppipad eirnpvvlra
481 lsgarkving vvrrygspar ihietarevg
    ksfkdrkeie krqeenrkdr ekaaakfrey
541 fpnfvgepks kdilklrlye qqhgkclysg
    keinlgrine kgyveidhal pfsrtwddsf
601 nnkvlvlgse nqnkgnqtpy eyfngkdnsr
    ewqefkarve tsrfprskkq rillqkfded
661 gfkernlndt ryvnrflcqf vadrmrltgk
    gkkrvfasng gitnllrgfw glrkvraend
721 rhhaldavvv acstvamqqk itrfvrykem
    nafdgktidk etgevlhqkt hfpqpweffa
781 qevmirvfgk pdgkpefeea dtpeklrtll
    aeklssrpea vheyvtplfv srapnrkmsg
```

-continued
```
841 qghmetvksa krldegvsvl rvpltqlklk
    dlekmvnrer epklyealka rleahkddpa
901 kafaepfyky dkagnrtqqv kavrveqvqk
    tgvwvrnhng iadnatmvry dvfekgdkyy
961 lvpiyswqva kgilpdravv qgkdeedwql
    iddsfnfkfs lhpndlvevi tkkarmfgyf
1021 aschrgtgni nirihdldhk igkngilegi
    gvktalsfqk yqidelgkei rperlkkrpp
1081 vr (SEQ ID NO: 34)
```

Another exemplary *Neisseria meningitidis* Cas9 protein, Nme2Cas9, (NCBI Reference: WP_002230835; type II CRISPR RNA-guided endonuclease Cas9) has the following amino acid sequence:

```
  1 maafkpnpin yilgldigia svgwamveid
    eeenpirlid lgvrvferae vpktgdslam
 61 arrlarsvrr ltrrrahrll rarrllkreg
    vlqaadfden glikslpntp wqlraaaldr
121 kltplewsav llhlikhrgy lsqrkneget
    adkelgallk gvannahalq tgdfrtpael
181 alnkfekesg hirnqrgdys htfsrkdlqa
    elilllfekqk efgnphvsgg lkegietllm
241 tqrpalsgda vqkmlghctf epaepkaakn
    tytaerfiwl tklnnlrile qgserpltdt
301 eratlmdepy rkskltyaqa rkllgledta
    ffkglrygkd naeastlmem kayhaisral
361 ekeglkdkks pinlsselqd eigtafslfk
    tdeditgrlk drvqpeilea llkhisfdkf
421 vqislkalrr ivplmeqgkr ydeacaeiyg
    dhygkkntee kiylppipad eirnpvvlra
481 lsgarkving vvrrygspar ihietarevg
    ksfkdrkeie krqeenrkdr ekaaakfrey
541 fpnfvgepks kdilklrlye qqhgkclysg
    keinlvrine kgyveidhal pfsrtwddsf
601 nnkvlvlgse nqnkgnqtpy eyfngkdnsr
    ewqefkarve tsrfprskkq rillqkfded
661 gfkecnlndt ryvnrflcqf vadhilltgk
    gkrrvfasng gitnllrgfw glrkvraend
721 rhhaldavvv acstvamqqk itrfvrykem
    nafdgktidk etgkvlhqkt hfpqpweffa
781 qevmirvfgk pdgkpefeea dtpeklrtll
    aeklssrpea vheyvtplfv srapnrkmsg
```

```
    841 ahkdtlrsak rfvkhnekis vkrvwlteik ladlenmvny kngreielye alkarleayg 901 gnakqafdpk dnpfykkggq lvkavrvekt qesgvllnkk naytiadngd mvrvdvfckv 961 dkkgknqyfi vpiyawqvae nilpdidckg yriddsytfc fslhkydlia fqkdekskve 1021 fayyincdss ngrfylawhd kgskeqqfri stqnlvliqk yqvnelgkei rperlkkrpp 1081 vr (SEQ ID NO: 35)
```

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a

MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQG<u>DSLHEHIANLAGSPAIKKGILQTVKVV</u>

<u>DELVKVMGRHKPENIVIEMARENQTTQKGQKNSRERMKRIEEGIKELGSQILKEHPVENTQL</u>

<u>QNEKLYLYYLQNGRDMYVDQELDINRLSDYDVDAIVPQSFLKDDSIDNKVLTRSDKNRGKSD</u>

<u>NVPSEEVVKKMKNYWRQLLNAKLITQRKFDNLTKAERGGLSELDKAGFIKRQLVETRQITKH</u>

<u>VAQILDSRMNTKYDENDKLIREVKVITLKSKLVSDFRKDFQFYKVREINNYHHAHDAYLNAV</u>

<u>VGTALIKKYPKLESEFVYGDYKVYDVRKMIAKSEQEIGKATAKYFFYSNIMNFFKTEITLAN</u>

<u>GEIRKRPLIETNGETGEIVWDKGRDFATVRKVLSMPQVNIVKKTEVQTGGFSKESILPKRNS</u>

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 36)
(single underline: HNH domain; double underline: RuvC domain).

In some embodiments, the Cas9 domain comprises a D10A mutation, while the residue at position 840 remains a histidine in the amino acid sequence provided above, or at Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9. IDC-52 DNA M Exemplary catalytically inactive Cas9 (dCas9):

```
Exemplary catalytically inactive Cas9 (dCas9):
DKKYSIGLAIGTNSVGWAVITDEYKVPSKKFKVLGNTDRHSIKKNLIGALLFDSGETAEATR

LKRTARRRYTRRKNRICYLQEIFSNEMAKVDDSFFHRLEESFLVEEDKKHERHPIFGNIVDE

VAYHEKYPTIYHLRKKLVDSTDKADLRLIYLALAHMIKFRGHFLIEGDLNPDNSDVDKLFIQ

LVQTYNQLFEENPINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDAILLSDILRVNTE

ITKAPLSASMIKRYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAILRRQEDFYPFLKD

NREKIEKILTFRIPYYVGPLARGNSRFAWMTRKSEETITPWNFEEVVDKGASAQSFIERMTN

FDKNLPNEKVLPKHSLLYEYFTVYNELTKVKYVTEGMRKPAFLSGEQKKAIVDLLFKTNRKV

TVKQLKEDYFKKIECFDSVEISGVEDRFNASLGTYHDLLKIIKDKDFLDNEENEDILEDIVL

TLTLFEDREMIEERLKTYAHLFDDKVMKQLKRRRYTGWGRLSRKLINGIRDKQSGKTILDFL

KSDGFANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVENTQLQ

NEKLYLYYLQNGRDMYVDQELDINRLSDYDVDAIVPQSFLKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD (SEQ ID NO: 37)

Exemplary catalytically Cas9 nickase (nCas9):
DKKYSIGLAIGTNSVGWAVITDEYKVPSKKFKVLGNTDRHSIKKNLIGALLFDSGETAEATR

LKRTARRRYTRRKNRICYLQEIFSNEMAKVDDSFFHRLEESFLVEEDKKHERHPIFGNIVDE

VAYHEKYPTIYHLRKKLVDSTDKADLRLIYLALAHMIKFRGHFLIEGDLNPDNSDVDKLFIQ

LVQTYNQLFEENPINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDAILLSDILRVNTE

ITKAPLSASMIKRYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAILRRQEDFYPFLKD

NREKIEKILTFRIPYYVGPLARGNSRFAWMTRKSEETITPWNFEEVVDKGASAQSFIERMTN

FDKNLPNEKVLPKHSLLYEYFTVYNELTKVKYVTEGMRKPAFLSGEQKKAIVDLLFKTNRKV

TVKQLKEDYFKKIECFDSVEISGVEDRFNASLGTYHDLLKIIKDKDFLDNEENEDILEDIVL

TLTLFEDREMIEERLKTYAHLFDDKVMKQLKRRRYTGWGRLSRKLINGIRDKQSGKTILDFL
```

```
-continued
KSDGFANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVENTQLQ

NEKLYLYYLQNGRDMYVDQELDINRLSDYDVDHIVPQSFLKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD (SEQ ID NO: 38)

Exemplary catalytically active Cas9:
DKKYSIGLDIGTNSVGWAVITDEYKVPSKKFKVLGNTDRHSIKKNLIGALLFDSGETAEATR

LKRTARRRYTRRKNRICYLQEIFSNEMAKVDDSFFHRLEESFLVEEDKKHERHPIFGNIVDE

VAYHEKYPTIYHLRKKLVDSTDKADLRLIYLALAHMIKFRGHFLIEGDLNPDNSDVDKLFIQ

LVQTYNQLFEENPINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDAILLSDILRVNTE

ITKAPLSASMIKRYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAILRRQEDFYPFLKD

NREKIEKILTFRIPYYVGPLARGNSRFAWMTRKSEETITPWNFEEVVDKGASAQSFIERMTN

FDKNLPNEKVLPKHSLLYEYFTVYNELTKVKYVTEGMRKPAFLSGEQKKAIVDLLFKTNRKV

TVKQLKEDYFKKIECFDSVEISGVEDRFNASLGTYHDLLKIIKDKDFLDNEENEDILEDIVL

TLTLFEDREMIEERLKTYAHLFDDKVMKQLKRRRYTGWGRLSRKLINGIRDKQSGKTILDFL

KSDGFANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVENTQLQ

NEKLYLYYLQNGRDMYVDQELDINRLSDYDVDHIVPQSFLKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD (SEQ ID NO: 39).
```

In some embodiments, Cas9 refers to a Cas9 from archaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In particular embodiments, napDNAbps useful in the methods of the disclosure include circular permutants, which are known in the art and described, for example, by Oakes et al., Cell 176, 254-267, 2019. An exemplary circular permutant follows where the bold sequence indicates sequence derived from Cas9, the italics sequence denotes a linker sequence, and the underlined sequence denotes a bipartite nuclear localization sequence, CP5 (with MSP "NGC=Pam Variant with mutations Regular Cas9 likes NGG" PID=Protein Interacting Domain and "D10A" nickase):

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least

```
EIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFMQPTVAYSVLVVAKVEK

GKSKKLKSVKELLGITIMERSSFEKNPIDFLEAKGYKEVKKDLIIKLPKYSLFELENGRKRM

LASAKFLQKGNELALPSKYVNFLYLASHYEKLKGSPEDNEQKQLFVEQHKHYLDEIIEQISE

FSKRVILADANLDKVLSAYNKHRDKPIREQAENIIHLFTLTNLGAPRAFKYFDTTIARKEYR

STKEVLDATLIHQSITGLYETRIDLSQLGGDGGSGGSGGSGGSGGSGGSGGMDKKYSIGLAI

GTNSVGWAVITDEYKVPSKKFKVLGNTDRHSIKKNLIGALLFDSGETAEATRLKRTARRRYT

RRKNRICYLQEIFSNEMAKVDDSFFHRLEESFLVEEDKKHERHPIFGNIVDEVAYHEKYPTI

YHLRKKLVDSTDKADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSLGLTPNFKSNFDLA

EDAKLQLSKDTYDDDLDNLLAQIGDQYADLFLAAKNLSDAILLSDILRVNTEITKAPLSASM

IKRYDEHHQDLTLLKALVRQQLPEKYKEIFFDQSKNGYAGYIDGGASQEEFYKFIKPILEKM

DGTEELLVKLNREDLLRKQRTFDNGSIPHQIHLGELHAILRRQEDFYPFLKDNREKIEKILT

FRIPYYVGPLARGNSRFAWMTRKSEETITPWNFEEVVDKGASAQSFIERMTNFDKNLPNEKV

LPKHSLLYEYFTVYNELTKVKYVTEGMRKPAFLSGEQKKAIVDLLFKTNRKVTVKQLKEDYF

KKIECFDSVEISGVEDRFNASLGTYHDLLKIIKDKDFLDNEENEDILEDIVLTLTLFEDREM

IEERLKTYAHLFDDKVMKQLKRRRYTGWGRLSRKLINGIRDKQSGKTILDFLKSDGFANRNF

MQLIHDDSLTFKEDIQKAQVSGQGDSLHEHIANLAGSPAIKKGILQTVKVVDELVKVMGRHK

PENIVIEMARENQTTQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRGKSDNVPSEEVVKKM

KNYWRQLLNAKLITQRKFDNLTKAERGGLSELDKAGFIKRQLVETRQITKHVAQILDSRMNT

KYDENDKLIREVKVITLKSKLVSDFRKDFQFYKVREINNYHHAHDAYLNAVVGTALIKKYPK

LESEFVYGDYKVYDVRKMIAKSEQEGADKRTADGSEFESPKKKRKV* (SEQ ID NO: 12)
```

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN).

97%, at least 98%, at least 99%, or at ease 99.5% identical to any CasX or CasY protein described herein. It should be appreciated that Cas12b/C2c1, CasX and CasY from other bacterial species may also be used in accordance with the present disclosure.

Cas12b/C2c1 (uniprot.org/uniprot/T0D7A2#2)
sp|T0D7A2|C2C_1_ALIAG CRISPR-associated endo-nuclease
C2c1 OS = *Alicyclobacillus acido-terrestris*
(strain ATCC 49025/DSM 3922/CIP 106132/
NCIMB 13137/GD3B) GN = c2c1 PE = 1 SV = 1
MAVKSIKVKLRLDDMPEIRAGLWKLHKEVNAGVRYYTEWLSLLRQENLYRRSPNGDGEQECD

KTAEECKAELLERLRARQVENGHRGPAGSDDELLQLARQLYELLVPQAIGAKGDAQQIARKF

LSPLADKDAVGGLGIAKAGNKPRWVRMREAGEPGWEEEKEKAETRKSADRTADVLRALADFG

LKPLMRVYTDSEMSSVEWKPLRKGQAVRTWDRDMFQQAIERMMSWESWNQRVGQEYAKLVEQ

KNRFEQKNFVGQEHLVHLVNQLQQDMKEASPGLESKEQTAHYVTGRALRGSDKVFEKWGKLA

PDAPFDLYDAEIKNVQRRNTRRFGSHDLFAKLAEPEYQALWREDASFLTRYAVYNSILRKLN

HAKMFATFTLPDATAHPIWTRFDKLGGNLHQYTFLFNEFGERRHAIRFHKLLKVENGVAREV

DDVTVPISMSEQLDNLLPRDPNEPIALYFRDYGAEQHFTGEFGGAKIQCRRDQLAHMHRRRG

ARDVYLNVSVRVQSQSEARGERRPPYAAVFRLVGDNHRAFVHFDKLSDYLAEHPDDGKLGSE

GLLSGLRVMSVDLGLRTSASISVFRVARKDELKPNSKGRVPFFFPIKGNDNLVAVHERSQLL

KLPGETESKDLRAIREERQRTLRQLRTQLAYLRLLVRCGSEDVGRRERSWAKLIEQPVDAAN

HMTPDWREAFENELQKLKSLHGICSDKEWMDAVYESVRRVWRHMGKQVRDWRKDVRSGERPK

IRGYAKDVVGGNSIEQIEYLERQYKFLKSWSFFGKVSGQVIRAEKGSRFAITLREHIDHAKE

DRLKKLADRIIMEALGYVYALDERGKGKWVAKYPPCQLILLEELSEYQFNNDRPPSENNQLM

QWSHRGVFQELINQAQVHDLLVGTMYAAFSSRFDARTGAPGIRCRRVPARCTQEHNPEPFPW

WLNKFVVEHTLDACPLRADDLIPTGEGEIFVSPFSAEEGDFHQIHADLNAAQNLQQRLWSDF

DISQIRLRCDWGEVDGELVLIPRLTGKRTADSYSNKVFYTNTGVTYYERERGKKRRKVFAQE

KLSEEEAELLVEADEAREKSVVLMRDPSGIINRGNWTRQKEFWSMVNQRIEGYLVKQIRSR

VPLQDSACENTGDI (SEQ ID NO: 40)

CasX (uniprot.org/uniprot/F0NN87; uniprot.org/uniprot/F0NH53)
>tr|F0NN87|F0NN87_SULIH CRISPR-associated
Casx protein OS = *Sulfolobus islandicus* (strain HVE10/4)
GN = SiH_0402 PE = 4 SV = 1
MEVPLYNIFGDNYIIQVATEAENSTIYNNKVEIDDEELRNVLNLAYKIAKNNEDAAAERRGK

AKKKKGEEGETTTSNIILPLSGNDKNPWTETLKCYNFPTTVALSEVFKNFSQVKECEEVSAP

SFVKPEFYEFGRSPGMVERTRRVKLEVEPHYLIIAAAGWVLTRLGKAKVSEGDYVGVNVFTP

TRGILYSLIQNVNGIVPGIKPETAFGLWIARKVVSSVTNPNVSVVRIYTISDAVGQNPTTIN

GGFSIDLTKLLEKRYLLSERLEAIARNALSISSNMRERYIVLANYIYEYLTG SKRLEDLLY

FANRDLIMNLNSDDGKVRDLKLISAYVNGELIRGEG (SEQ ID NO: 41)

>tr|F0NH53|F0NH53_SULIR CRISPR associated protein,
Casx OS = *Sulfolobus islandicus* (strain REY15A)
GN = SiRe_0771 PE = 4 SV = 1
MEVPLYNIFGDNYIIQVATEAENSTIYNNKVEIDDEELRNVLNLAYKIAKNNEDAAAERRGK

AKKKKGEEGETTTSNIILPLSGNDKNPWTETLKCYNFPTTVALSEVFKNFSQVKECEEVSAP

SFVKPEFYKFGRSPGMVERTRRVKLEVEPHYLIMAAAGWVLTRLGKAKVSEGDYVGVNVFTP

TRGILYSLIQNVNGIVPGIKPETAFGLWIARKVVSSVTNPNVSVVSIYTISDAVGQNPTTIN

GGFSIDLTKLLEKRDLLSERLEAIARNALSISSNMRERYIVLANYIYEYLTGSKRLEDLLYF

ANRDLIMNLNSDDGKVRDLKLISAYVNGELIRGEG (SEQ ID NO: 42)

Deltaproteobacteria CasX
MEKRINKIRKKLSADNATKPVSRSGPMKTLLVRVMTDDLKKRLEKRRKKPEVMPQVISNNAA

NNLRMLLDDYTKMKEAILQVYWQEFKDDHVGLMCKFAQPASKKIDQNKLKPEMDEKGNLTTA

-continued

```
GFACSQCGQPLFVYKLEQVSEKGKAYTNYFGRCNVAEHEKLILLAQLKPVKDSDEAVTYSLG

KFGQRALDFYSIHVTKESTHPVKPLAQIAGNRYASGPVGKALSDACMGTIASFLSKYQDIII

EHQKVVKGNQKRLESLRELAGKENLEYPSVTLPPQPHTKEGVDAYNEVIARVRMWVNLNLWQ

KLKLSRDDAKPLLRLKGFPSFPVVERRENEVDWWNTINEVKKLIDAKRDMGRVFWSGVTAEK

RNTILEGYNYLPNENDHKKREGSLENPKKPAKRQFGDLLLYLEKKYAGDWGKVFDEAWERID

KKIAGLTSHIEREEARNAEDAQSKAVLTDWLRAKASFVLERLKEMDEKEFYACEIQLQKWYG

DLRGNPFAVEAENRVVDISGFSIGSDGHSIQYRNLLAWKYLENGKREFYLLMNYGKKGRIRF

TDGTDIKKSGKWQGLLYGGGKAKVIDLTFDPDDEQLIILPLAFGTRQGREFIWNDLLSLETG

LIKLANGRVIEKTIYNKKIGRDEPALFVALTFERREVVDPSNIKPVNLIGVARGENIPAVIA

LTDPEGCPLPEFKDSSGGPTDILRIGEGYKEKQRAIQAAKEVEQRRAGGYSRKFASKSRNLA

DDMVRNSARDLFYHAVTHDAVLVFANLSRGFGRQGKRTFMTERQYTKMEDWLTAKLAYEGLT

SKTYLSKTLAQYTSKTCSNCGFTITYADMDVMLVRLKKTSDGWATTLNNKELKAEYQITYYN

RYKRQTVEKELSAELDRLSEESGNNDISKWTKGRRDEALFLLKKRFSHRPVQEQFVCLDCGH

EVHAAEQAALNIARSWLFLNSNSTEFKSYKSGKQPFVGAWQAFYKRRLKEVWKPNA
(SEQ ID NO: 43)

CasY (ncbi.nlm.nih.gov/protein/APG80656.1)
>APG80656.1 CRISPR-associated protein CasY
[uncultured Parcubacteria group bacterium]
MSKRHPRISGVKGYRLHAQRLEYTGKSGAMRTIKYPLYSSPSGGRTVPREIVSAINDDYVGL

YGLSNFDDLYNAEKRNEEKVYSVLDFWYDCVQYGAVFSYTAPGLLKNVAEVRGGSYELTKTL

KGSHLYDELQIDKVIKFLNKKEISRANGSLDKLKKDIIDCFKAEYRERHKDQCNKLADDIKN

AKKDAGASLGERQKKLFRDFFGISEQSENDKPSFTNPLNLTCCLLPFDTVNNNRNRGEVLFN

KLKEYAQKLDKNEGSLEMWEYIGIGNSGTAFSNFLGEGFLGRLRENKITELKKAMMDITDAW

RGQEQEEELEKRLRILAALTIKLREPKFDNHWGGYRSDINGKLSSWLQNYINQTVKIKEDLK

GHKKDLKKAKEMINRFGESDTKEEAVVSSLLESIEKIVPDDSADDEKPDIPAIAIYRRFLSD

GRLTLNRFVQREDVQEALIKERLEAEKKKKPKKRKKKSDAEDEKETIDFKELFPHLAKPLKL

VPNFYGDSKRELYKKYKNAAIYTDALWKAVEKIYKSAFSSSLKNSFFDTDFDKDFFIKRLQK

IFSVYRRFNTDKWKPIVKNSFAPYCDIVSLAENEVLYKPKQSRSRKSAAIDKNRVRLPSTEN

IAKAGIALARELSVAGFDWKDLLKKEEHEEYIDLIELHKTALALLLAVTETQLDISALDFVE

NGTVKDFMKTRDGNLVLEGRFLEMFSQSIVFSELRGLAGLMSRKEFITRSAIQTMNGKQAEL

LYIPHEFQSAKITTPKEMSRAFLDLAPAEFATSLEPESLSEKSLLKLKQMRYYPHYFGYELT

RTGQGIDGGVAENALRLEKSPVKKREIKCKQYKTLGRGQNKIVLYVRSSYYQTQFLEWFLHR

PKNVQTDVAVSGSFLIDEKKVKTRWNYDALTVALEPVSGSERVFVSQPFTIFPEKSAEEEGQ

RYLGIDIGEYGIAYTALEITGDSAKILDQNFISDPQLKTLREEVKGLKLDQRRGTFAMPSTK

IARIRESLVHSLRNRIHHLALKHKAKIVYELEVSRFEEGKQKIKKVYATLKKADVYSEIDAD

KNLQTTVWGKLAVASEISASYTSQFCGACKKLWRAEMQVDETITTQELIGTVRVIKGGTLID

AIKDFMRPPIFDENDTPFPKYRDFCDKHHISKKMRGNSCLFICPFCRANADADIQASQTIAL

LRYVKEEKKVEDYFERFRKLKNIKVLGQMKKI (SEQ ID NO: 44)
```

The term "Cas12" or "Cas12 domain" refers to an RNA guided nuclease comprising a Cas12 protein or a fragment thereof (e.g., a protein comprising an active, inactive, or partially active DNA cleavage domain of Cas12, and/or the gRNA binding domain of Cas12). Cas12 belongs to the class 2, Type V CRISPR/Cas system. A Cas12 nuclease is also referred to sometimes as a CRISPR (clustered regularly interspaced short palindromic repeat) associated nuclease. The sequence of an exemplary Bacillus hisashii Cas 12b (BhCas12b) Cas 12 domain is provided below:

```
MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDENEPSEKYLEVFKDYQRKHPREAGDYSVYEFLSKKENHFIWRNHPEYPY

LYATFCEIDKKKKDAKQQATFTLADPINHPLWVRFEERSGSNLNKYRILTEQLHTEKLKKKL

TVQLDRLIYPTESGGWEEKGKVDIVLLPSRQFYNQIFLDIEEKGKHAFTYKDESIKFPLKGT

LGGARVQFDRDHLRRYPHKVESGNVGRIYFNMTVNIEPTESPVSKSLKIHRDDFPKVVNFKP

KELTEWIKDSKGKKLKSGIESLEIGLRVMSIDLGQRQAAAASIFEVVDQKPDIEGKLFFPIK

GTELYAVHRASFNIKLPGETLVKSREVLRKAREDNLKLMNQKLNFLRNVLHFQQFEDITERE

KRVTKWISRQENSDVPLVYQDELIQIRELMYKPYKDWVAFLKQLHKRLEVEIGKEVKHWRKS

LSDGRKGLYGISLKNIDEIDRTRKFLLRWSLRPTEPGEVRRLEPGQRFAIDQLNHLNALKED

RLKKMANTIIMHALGYCYDVRKKKWQAKNPACQIILFEDLSNYNPYEERSRFENSKLMKWSR

REIPRQVALQGEIYGLQVGEVGAQFSSRFHAKTGSPGIRCSVVTKEKLQDNRFFKNLQREGR

LTLDKIAVLKEGDLYPDKGGEKFISLSKDRKCVTTHADINAAQNLQKRFWTRTHGFYKVYCK

AYQVDGQTVYIPESKDQKQKIIEEFGEGYFILKDGVYEWVNAGKLKIKKGSSKQSSSELVDS

DILKDSFDLASELKGEKLMLYRDPSGNVFPSDKWMAAGVFFGKLERILISKLTNQYSISTIE

DDSSKQSMKRPAATKKAGQAKKKK (SEQ ID NO: 45).
```

Amino acid sequences having at least 85% or greater identity to the BhCas12b amino acid sequence are also useful in the methods of the disclosure.

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa such that a positive charge can be maintained; glutamic acid for aspartic acid and vice versa such that a negative charge can be maintained; serine for threonine such that a free —OH can be maintained; and glutamine for asparagine such that a free —NH$_2$ can be maintained.

The term "coding sequence" or "protein coding sequence" as used interchangeably herein refers to a segment of a polynucleotide that codes for a protein. The region or sequence is bounded nearer the 5' end by a start codon and nearer the 3' end with a stop codon. Coding sequences can also be referred to as open reading frames.

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. PmCDA1 derived from *Petromyzon marinus* (*Petromyzon marinus* cytosine deaminase 1), or AID (Activation-induced cytidine deaminase; AICDA) derived from a mammal (e.g., human, swine, bovine, horse, monkey etc.), and APOBEC are exemplary cytidine deaminases.

The term "deaminase" or "deaminase domain," as used herein, refers to a protein or enzyme that catalyzes a deamination reaction. In some embodiments, the deaminase is an adenosine deaminase, which catalyzes the hydrolytic deamination of adenine to hypoxanthine. In some embodiments, the deaminase is an adenosine deaminase, which catalyzes the hydrolytic deamination of adenosine or adenine (A) to inosine (I). In some embodiments, the deaminase or deaminase domain is an adenosine deaminase catalyzing the hydrolytic deamination of adenosine or deoxyadenosine to inosine or deoxyinosine, respectively. In some embodiments, the adenosine deaminase catalyzes the hydrolytic deamination of adenosine in deoxyribonucleic acid (DNA). The adenosine deaminases (e.g., engineered adenosine deaminases, evolved adenosine deaminases) provided herein can be from any organism, such as a bacterium. In some embodiments, the adenosine deaminase is from a bacterium, such as *Escherichia coli, Staphylococcus aureus, Salmonella typhimurium, Shewanella putrefaciens, Haemophilus influenzae*, or *Caulobacter crescentus*.

In some embodiments, the adenosine deaminase is a TadA deaminase. In some embodiments, the TadA deaminase is TadA variant. In some embodiments, the TadA variant is a TadA*8. In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally occurring deaminase. For example, deaminase domains are described in International PCT Application Nos. PCT/2017/045381 (WO 2018/027078) and PCT/US2016/058344 (WO 2017/070632), each of which is incorporated herein by reference for its entirety. Also, see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017)), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ.

The term "effective amount," as used herein, refers to an amount of a biologically active agent that is sufficient to elicit a desired biological response. The effective amount of an active agent(s) used to practice the present disclosure for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount. In one embodiment, an effective amount is the amount of a base editor of the disclosure (e.g., a fusion protein comprising a programmable DNA binding protein, a nucleobase editor and gRNA) sufficient to introduce an alteration in a gene of interest in a cell (e.g., a cell in vitro or in vivo). In one embodiment, an effective amount is the amount of a base editor required to achieve a therapeutic effect (e.g., to reduce or control a disease or a symptom or condition thereof). Such therapeutic effect need not be sufficient to alter a gene of interest in all cells of a subject, tissue or organ, but only to alter a gene of interest in about 1%, 5%, 10%, 25%, 50%, 75% or more of the cells present in a subject, tissue or organ.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

By "guide RNA" or "gRNA" is meant a polynucleotide which can be specific for a target sequence and can form a complex with a polynucleotide programmable nucleotide binding domain protein (e.g., Cas9 or Cpf1). In an embodiment, the guide polynucleotide is a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821 (2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases and Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." An extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex.

By "heterodimer" is meant a fusion protein comprising two domains, such as a wild type TadA domain and a variant of TadA domain (e.g., TadA*8) or two variant TadA domains (e.g., TadA*7.10 and TadA*8 or two TadA*8 domains).

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

The term "inhibitor of base repair" or "IBR" refers to a protein that is capable in inhibiting the activity of a nucleic acid repair enzyme, for example a base excision repair (BER) enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 Endo1, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG. In some embodiments, the base repair inhibitor is an inhibitor of Endo V or hAAG. In some embodiments, the base repair inhibitor is a catalytically inactive EndoV or a catalytically inactive hAAG.

In some embodiments, the base repair inhibitor is uracil glycosylase inhibitor (UGI). UGI refers to a protein that is capable of inhibiting a uracil-DNA glycosylase base-excision repair enzyme. In some embodiments, a UGI domain comprises a wild-type UGI or a fragment of a wild-type UGI. In some embodiments, the UGI proteins provided herein include fragments of UGI and proteins homologous to a UGI or a UGI fragment. In some embodiments, the base repair inhibitor is an inhibitor of inosine base excision repair. In some embodiments, the base repair inhibitor is a "catalytically inactive inosine specific nuclease" or "dead inosine specific nuclease. Without wishing to be bound by any particular theory, catalytically inactive inosine glycosylases (e.g., alkyl adenine glycosylase (AAG)) can bind inosine, but cannot create an abasic site or remove the inosine, thereby sterically blocking the newly formed inosine moiety from DNA damage/repair mechanisms. In some embodiments, the catalytically inactive inosine specific nuclease can be capable of binding an inosine in a nucleic acid but does not cleave the nucleic acid. Non-limiting exemplary catalytically inactive inosine specific nucleases include catalytically inactive alkyl adenosine glycosylase (AAG nuclease), for example, from a human, and catalytically inactive endonuclease V (EndoV nuclease), for example, from E. coli. In some embodiments, the catalytically inactive AAG nuclease comprises an E125Q mutation or a corresponding mutation in another AAG nuclease.

By "increases" is meant a positive alteration of at least 10%, 25%, 50%, 75%, or 100%.

An "intein" is a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Other intein systems may also be used. For example, a synthetic intein based on the dnaE intein, the Cfa-N (e.g., split intein-N) and Cfa-C (e.g., split intein-C) intein pair, has been described (e.g., in Stevens et al., J Am Chem Soc. 2016 Feb. 24; 138(7):2162-5, incorporated herein by reference). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference.

Exemplary nucleotide and amino acid sequences of inteins are provided.

```
DnaE Intein-N DNA:
TGCCTGTCATACGAAACCGAGATACTGACAGTAGAATATGGCCTTCTGCCATCGGGAAGAT

TGTGGAGAAACGGATAGAATGCACAGTTTACTCTGTCGATAACAATGGTAACATTTATACTC

AGCCAGTTGCCCAGTGGCACGACCGGGGAGAGCAGGAAGTATTCGAATACTGTCTGGAGGAT

GGAAGTCTCATTAGGGCCACTAAGGACCACAAATTTATGACAGTCGATGGCCAGATGCTGCC

TATAGACGAAATCTTTGAGCGAGAGTTGGACCTCATGCGAGTTGACAACCTICCTAT
(SEQ ID NO: 46)

DnaE Intein-N Protein:
CLSYETEILTVEYGLLPIGKIVEKRIECTVYSVDNNGNIYTQPVAQWHDR

GEQEVFEYCLEDGSLIRATKDHKFMTVDGQMLPIDEIFERELDLMRVDNLPN
(SEQ ID NO: 47)

DnaE Intein-C DNA:
ATGATCAAGATAGCTACAAGGAAGTATCTTGGCAAACAAAACGTTTATGA

TATTGGAGTCGAAAGAGATCACAACTTTGCTCTGAAGAACGGATTCATAGCTTCTAT
(SEQ ID NO: 48)

Intein-C:
MIKIATRKYLGKQNVYDIGVERDHNFALKNGFIASN (SEQ ID NO: 49)

Cfa-N DNA:
TGCCTGTCTTATGATACCGAGATACTTACCGTTGAATATGGCTTCTTGCCTATTGGAAAGAT

TGTCGAAGAGAGAATTGAATGCACAGTATATACTGTAGACAAGAATGGTTTCGTTTACACAC

AGCCCATTGCTCAATGGCACAATCGCGGCGAACAAGAAGTATTTGAGTACTGTCTCGAGGAT

GGAAGCATCATACGAGCAACTAAAGATCATAAATTCATGACCACTGACGGGCAGATGTTGCC

AATAGATGAGATATTCGAGCGGGCTTGGATCTCAAACAAGTGGATGGATTGCCA
(SEQ ID NO: 50)

Cfa-N Protein:
CLSYDTEILTVEYGFLPIGKIVEERIECTVYTVDKNGFVYTQPIAQWHNRGEQEVFEYCLED

GSIIRATKDHKFMTTDGQMLPIDEIFERGLDLKQVDGLP (SEQ ID NO: 51)
```

-continued

Cfa-C DNA:
ATGAAGAGGACTGCCGATGGATCAGAGTTTGAATCTCCCAAGAAGAAGAGGAAAGTAAAGAT

AATATCTCGAAAAAGTCTTGGTACCCAAAATGTCTATGATATTGGAGTGGAGAAAGATCACA

ACTTCCITCTCAAGAACGGTCTCGTAGCCAGCAAC (SEQ ID NO: 52)

Cfa-C Protein:
MKRTADGSEFESPKKKRKVKIISRKSLGTQNVYDIGVEKDHNFLLKNGLVASN
(SEQ ID NO: 53)

Intein-N and intein-C may be fused to the N-terminal portion of the split Cas9 and the C-terminal portion of the split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N—[N-terminal portion of the split Cas9]-[intein-N]—C. In some embodiments, an intein-C is fused to the N-terminus of the C-terminal portion of the split Cas9, i.e., to form a structure of N-[intein-C]—[C-terminal portion of the split Cas9]-C. The mechanism of intein-mediated protein splicing for joining the proteins the inteins are fused to (e.g., split Cas9) is known in the art, e.g., as described in Shah et al., Chem Sci. 2014; 5(1):446-461, incorporated herein by reference. Methods for designing and using inteins are known in the art and described, for example by WO2014004336, WO2017132580, US20150344549, and US20180127780, each of which is incorporated herein by reference in their entirety.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this disclosure is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high-performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the disclosure is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the disclosure that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the disclosure. An isolated polypeptide of the disclosure may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker", as used herein, can refer to a covalent linker (e.g., covalent bond), a non-covalent linker, a chemical group, or a molecule linking two molecules or moieties, e.g., two components of a protein complex or a ribonucleocomplex, or two domains of a fusion protein, such as, for example, a polynucleotide programmable DNA binding domain (e.g., dCas9) and a deaminase domain ((e.g., an adenosine deaminase, a cytidine deaminase, or an adenosine deaminase and a cytidine deaminase; see PCT/US2019/044935, PCT/US2020/016288, each of which is incorporated herein by reference for its entirety). A linker can join different components of, or different portions of components of, a base editor system. For example, in some embodiments, a linker can join a guide polynucleotide binding domain of a polynucleotide programmable nucleotide binding domain and a catalytic domain of a deaminase. In some embodiments, a linker can join a CRISPR polypeptide and a deaminase. In some embodiments, a linker can join a Cas9 and a deaminase. In some embodiments, a linker can join a dCas9 and a deaminase. In some embodiments, a linker can join a nCas9 and a deaminase. In some embodiments, a linker can join a guide polynucleotide and a deaminase. In some embodiments, a linker can join a deaminating component and a polynucleotide programmable nucleotide binding component of a base editor system. In some embodiments, a linker can join a RNA-binding portion of a deaminating component and a polynucleotide programmable nucleotide binding component of a base editor system. In some embodiments, a linker can join a RNA-binding portion of a deaminating component and a RNA-binding portion of a polynucleotide programmable nucleotide binding component of a base editor system. A linker can be positioned between, or flanked by, two groups, molecules, or other moieties and connected to each one via a covalent bond or non-covalent interaction, thus connecting the two. In some embodiments, the linker can be an organic molecule, group, polymer, or chemical moiety. In some embodiments, the linker can be a polynucleotide. In some embodiments, the linker can be a DNA linker. In some embodiments, the linker can be a RNA linker. In some embodiments, a linker can comprise an aptamer capable of binding to a ligand. In some embodiments, the ligand may be carbohydrate, a peptide, a protein, or a nucleic acid. In some embodiments, the linker may comprise an aptamer may be derived from a riboswitch. The riboswitch from which the aptamer is derived may be selected from a theophylline riboswitch, a thiamine pyrophosphate (TPP) riboswitch, an adenosine cobalamin (AdoCbl) riboswitch, an S-adenosyl methionine (SAM) riboswitch, an SAH riboswitch, a flavin mononucleotide (FMN) riboswitch, a tetrahydrofolate riboswitch, a lysine riboswitch, a glycine riboswitch, a purine riboswitch, a GlmS riboswitch, or a pre-queosine1 (PreQ1) riboswitch. In some embodiments, a linker may comprise an aptamer bound to a polypeptide or a protein domain, such as a polypeptide ligand. In some embodiments, the polypeptide ligand may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif. In some embodiments, the polypeptide ligand may be a portion of a base editor system component. For example, a nucleobase editing component may comprise a deaminase domain and a RNA recognition motif.

In some embodiments, the linker can be an amino acid or a plurality of amino acids (e.g., a peptide or protein). In some embodiments, the linker can be about 5-100 amino acids in length, for example, about 5, 6, 7, 8, 9, 10, 11, 12, 13, 14, 15, 16, 17, 18, 19, 20, 20-30, 30-40, 40-50, 50-60, 60-70, 70-80, 80-90, or 90-100 amino acids in length. In some embodiments, the linker can be about 100-150, 150-200, 200-250, 250-300, 300-350, 350-400, 400-450, or 450-500 amino acids in length. Longer or shorter linkers can be also contemplated.

In some embodiments, a linker joins a gRNA binding domain of an RNA-programmable nuclease, including a Cas9 nuclease domain, and the catalytic domain of a nucleic-acid editing protein (e.g., adenosine deaminase). In some embodiments, a linker joins a dCas9 and a nucleic-acid editing protein. For example, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated.

In some embodiments, the domains of the nucleobase editor are fused via a linker that comprises the amino acid sequence of SGGSSGSETPGTSESATPESSGGS (SEQ ID NO: 54), SGGSSGGSSGSETPGTSESATPESSGGSSGGS (SEQ ID NO: 55), or GGSGGSPGSPAGSPTSTEEGTS-ESATPESGPGTSTEPSEGSAPGSPAGSPTSTEEGTSTE
PSEGSAPGTSTEPSEGSAPGTSESAT-
PESGPGSEPATSGGSGGS (SEQ ID NO: 56). In some embodiments, domains of the nucleobase editor are fused via a linker comprising the amino acid sequence SGSETPGTSESATPES, which may also be referred to as the XTEN linker. In some embodiments, a linker comprises the amino acid sequence SGGS (SEQ ID NO: 57). In some embodiments, a linker comprises (SGGS)$_n$ (SEQ ID NO: 58), (GGGS)$_n$ (SEQ ID NO: 59), (GGGGS)$_n$ (SEQ ID NO: 60), (G)$_n$ (SEQ ID NO: 61), (EAAAK)$_n$ (SEQ ID NO: 62), (GGS)$_n$ (SEQ ID NO: 63), SGSETPGTSESATPES (SEQ ID NO: 64), or (XP)$_n$ motif (SEQ ID NO: 65), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

In some embodiments, the linker is 24 amino acids in length. In some embodiments, the linker comprises the amino acid sequence SGGSSGGSSGSETPGTSESATPES (SEQ ID NO: 14). In some embodiments, the linker is 40 amino acids in length. In some embodiments, the linker comprises the amino acid sequence SGGSSGGSSG-SETPGTSESATPESSGGSSGGSSGGSSGGS (SEQ ID NO: 66). In some embodiments, the linker is 64 amino acids in length. In some embodiments, the linker comprises the amino acid sequence SGGSSGGSSGSETPGTSESAT-PESSGGSSGGSSGGSSGGSSGGSETPGTSESAT-
PESSGGS SGGS (SEQ ID NO: 67). In some embodiments, the linker is 92 amino acids in length. In some embodiments, the linker comprises the amino acid sequence PGSPAGSPT-STEEGTSESATPESGPGTSTEPSEGSAPGSPAGSPT-
STEEGTSTEPSEGSAPG TSTEPSEGSAPGTSESAT-
PESGPGSEPATS (SEQ ID NO: 68).

By "marker" is meant any protein or polynucleotide having an alteration in expression level or activity that is associated with a disease or disorder.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). In some embodiments, the presently disclosed base editors can efficiently generate an "intended mutation," such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., adenosine base editor) bound to a guide polynucleotide (e.g., gRNA), specifically designed to generate the intended mutation.

In general, mutations made or identified in a sequence (e.g., an amino acid sequence as described herein) are numbered in relation to a reference (or wild-type) sequence, i.e., a sequence that does not contain the mutations. The skilled practitioner in the art would readily understand how to determine the position of mutations in amino acid and nucleic acid sequences relative to a reference sequence.

The term "non-conservative mutations" involve amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 69), KRPAATKKAGQAKKKK (SEQ ID NO: 70), KKTELQTTNAENKTKKL (SEQ ID NO: 71), KRGINDRNFWRGENGRKTR (SEQ ID NO: 72), RKSGKIAAIVVKRPRK (SEQ ID NO: 73), PKKKRKV (SEQ ID NO: 74), or MDSLLMNRRKFLYQFKNVRWAKGRRETYLC (SEQ ID NO: 75).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanos- ine, 8-oxoadenosine, 8-oxoguanosine, O(6)-methylguanine, and 2-thiocytidine); chemically modified bases; biologically modified bases (e.g., methylated bases); intercalated bases; modified sugars (2'- e.g., fluororibose, ribose, 2'-deoxyribose, arabinose, and hexose); and/or modified phosphate groups (e.g., phosphorothioates and 5'-N-phosphoramidite linkages).

The term "nucleic acid programmable DNA binding protein" or "napDNAbp" may be used interchangeably with "polynucleotide programmable nucleotide binding domain" to refer to a protein that associates with a nucleic acid (e.g., DNA or RNA), such as a guide nucleic acid or guide polynucleotide (e.g., gRNA), that guides the napDNAbp to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPR J.* 2018 October; 1:325-336. doi: 10.1089/crispr.2018.0033; Yan et al., "Functionally diverse type V CRISPR-Cas systems" *Science.* 2019 Jan. 4; 363(6422):88-91. doi: 10.1126/science.aav7271, the entire contents of each are hereby incorporated by reference.

The term "nucleobase," "nitrogenous base," or "base," used interchangeably herein, refers to a nitrogen-containing biological compound that forms a nucleoside, which in turn is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6- dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (Ψ). A "nucleotide" consists of a nucleobase, a five carbon sugar (either ribose or deoxyribose), and at least one phosphate group.

The terms "nucleobase editing domain" or "nucleobase editing protein," as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) deaminations, as well as non-templated nucleotide additions and insertions. In some embodiments, the nucleobase editing domain is a deaminase domain (e.g., an adenine deaminase or an adenosine deaminase). In some embodiments, the nucleobase editing domain is more than one deaminase domain (e.g., an adenine deaminase or an adenosine deaminase and a cytidine or a cytosine deaminase). In some embodiments, the nucleobase editing domain can be a naturally occurring nucleobase editing domain. In some embodiments, the nucleobase editing domain can be an engineered or evolved nucleobase editing domain from the naturally occurring nucleobase editing domain. The nucleobase editing domain can be from any organism, such as a bacterium, human, chimpanzee, gorilla, monkey, cow, dog, rat, or mouse.

As used herein, "obtaining" as in "obtaining an agent" includes synthesizing, purchasing, or otherwise acquiring the agent.

A "patient" or "subject" as used herein refers to a mammalian subject or individual diagnosed with, at risk of having or developing, or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, camels, llamas, goats, sheep, rodents (e.g., mice, rabbits, rats, or guinea pigs) and other mammalians that can benefit from the therapies disclosed herein. Exemplary human patients can be male and/or female.

"Patient in need thereof" or "subject in need thereof" is referred to herein as a patient diagnosed with, at risk or having, predetermined to have, or suspected of having a disease or disorder.

The terms "pathogenic mutation," "pathogenic variant," "disease casing mutation," "disease causing variant," "deleterious mutation," or "predisposing mutation" refers to a genetic alteration or mutation that increases an individual's susceptibility or predisposition to a certain disease or disorder. In some embodiments, the pathogenic mutation comprises at least one wild-type amino acid substituted by at least one pathogenic amino acid in a protein encoded by a gene.

The terms "protein," "peptide," "polypeptide," and their grammatical equivalents are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide can refer to an individual protein or a collection of proteins. One or more of the amino acids in a protein, peptide, or polypeptide can be modified, for example, by the addition of a chemical entity such as a carbohydrate group, a hydroxyl group, a phosphate group, a farnesyl group, an isofarnesyl group, a fatty acid group, a linker for conjugation, functionalization, or other modifications, etc. A protein, peptide, or polypeptide can also be a single molecule or can be a multi-molecular complex. A protein, peptide, or polypeptide can be just a fragment of a naturally occurring protein or peptide. A protein, peptide, or polypeptide can be naturally occurring, recombinant, or synthetic, or any combination thereof. The term "fusion protein" as used herein refers to a hybrid polypeptide which comprises protein domains from at least two different proteins. One protein can be located at the amino-terminal (N-terminal) portion of the fusion protein or at the carboxy-terminal (C-terminal) protein thus forming an amino-terminal fusion protein or a carboxy-terminal fusion protein, respectively. A protein can comprise different domains, for example, a nucleic acid binding domain (e.g., the gRNA binding domain of Cas9 that directs the binding of the protein to a target site) and a nucleic acid cleavage domain, or a catalytic domain of a nucleic acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA or DNA. Any of the proteins provided herein can be produced by any method known in the art. For example, the proteins provided herein can be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine. The polypeptides and proteins can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitylation, addition of pyrrolidone carboxylic acid, formation of disulfide bridges, sulfation, myristoylation, palmitoylation, isoprenylation, farnesylation, geranylation, glypiation, lipoylation and iodination.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the reference is a wild-type or healthy cell. In other embodiments and without limitation, a reference is an untreated cell that is not subjected to a test condition, or is subjected to placebo or normal saline, medium, buffer, and/or a control vector that does not harbor a polynucleotide of interest.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, at least about 25 amino acids, about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, about 100 nucleotides or about 300 nucleotides or any integer thereabout or therebetween. In some embodiments, a reference sequence is a wild-type sequence of a protein of interest. In other embodiments, a reference sequence is a polynucleotide sequence encoding a wild-type protein.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et ah, Science 337:816-821(2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases and Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex.

In some embodiments, the RNA-programmable nuclease is the (CRISPR-associated system) Cas9 endonuclease, for example, Cas9 (Casnl) from *Streptococcus pyogenes* (see, e.g., "Complete genome sequence of an Ml strain of *Streptococcus pyogenes*." Ferretti J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011).

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. Science 339, 819-823 (2013); Mali, P. et ah, RNA-guided human genome engineering via Cas9. Science 339, 823-826 (2013); Hwang, W. Y. et al., Efficient genome editing in zebrafish using a CRISPR-Cas system. Nature biotechnology 31, 227-229 (2013); Jinek, M. et ah, RNA-programmed genome editing in human cells. eLife 2, e00471 (2013); Dicarlo, J. E. et al., Genome engineering in *Saccharomyces cerevisiae* using CRISPR-Cas systems. Nucleic acids research (2013); Jiang, W. et ah RNA-guided editing of bacterial genomes using CRISPR-Cas systems. Nature biotechnology 31, 233-239 (2013); the entire contents of each of which are incorporated herein by reference).

The term "single nucleotide polymorphism (SNP)" is a variation in a single nucleotide that occurs at a specific position in the genome, where each variation is present to some appreciable degree within a population (e.g., >1%). For example, at a specific base position in the human genome, the C nucleotide can appear in most individuals, but in a minority of individuals, the position is occupied by an A. This means that there is a SNP at this specific position, and the two possible nucleotide variations, C or A, are said to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs.

Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the disclosure, but which does not substantially recognize and bind other molecules in a sample, for example, a biological sample.

Nucleic acid molecules useful in the methods of the disclosure include any nucleic acid molecule that encodes a polypeptide of the disclosure or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the disclosure include any nucleic acid molecule that encodes a polypeptide of the disclosure or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100 µg/ml denatured salmon sperm DNA (ssDNA). In another embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "split" is meant divided into two or more fragments. A "split Cas9 protein" or "split Cas9" refers to a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a "reconstituted" Cas9 protein. In particular embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351: 867-871. PDB file: 5F9R, each of which is incorporated herein by reference. In some embodiments, the protein is divided into two fragments at any C, T, A, or S within a region of SpCas9 between about amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as "splitting" the protein.

In other embodiments, the N-terminal portion of the Cas9 protein comprises amino acids 1-573 or 1-637 S. pyogenes Cas9 wild-type (SpCas9) (NCBI Reference Sequence: NC_002737.2, Uniprot Reference Sequence: Q99ZW2) and the C-terminal portion of the Cas9 protein comprises a portion of amino acids 574-1368 or 638-1368 of SpCas9 wild-type, or a corresponding position thereof.

The C-terminal portion of the split Cas9 can be joined with the N-terminal portion of the split Cas9 to form a complete Cas9 protein. In some embodiments, the C-terminal portion of the Cas9 protein starts from where the N-terminal portion of the Cas9 protein ends. As such, in some embodiments, the C-terminal portion of the split Cas9 comprises a portion of amino acids (551-651)-1368 of spCas9. "(551-651)-1368" means starting at an amino acid between amino acids 551-651 (inclusive) and ending at amino acid 1368. For example, the C-terminal portion of the split Cas9 may comprise a portion of any one of amino acid 551-1368, 552-1368, 553-1368, 554-1368, 555-1368, 556-1368, 557-1368, 558-1368, 559-1368, 560-1368, 561-1368, 562-1368, 563-1368, 564-1368, 565-1368, 566-1368, 567-1368, 568-1368, 569-1368, 570-1368, 571-1368, 572-1368, 573-1368, 574-1368, 575-1368, 576-1368, 577-1368, 578-1368, 579-1368, 580-1368, 581-1368, 582-1368, 583-1368, 584-1368, 585-1368, 586-1368, 587-1368, 588-1368, 589-1368, 590-1368, 591-1368, 592-1368, 593-1368, 594-1368, 595-1368, 596-1368, 597-1368, 598-1368, 599-1368, 600-1368, 601-1368, 602-1368, 603-1368, 604-1368, 605-1368, 606-1368, 607-1368, 608-1368, 609-1368, 610-1368, 611-1368, 612-1368, 613-1368, 614-1368, 615-1368, 616-1368, 617-1368, 618-1368, 619-1368, 620-1368, 621-1368, 622-1368, 623-1368, 624-1368, 625-1368, 626-1368, 627-1368, 628-1368, 629-1368, 630-1368, 631-1368, 632-1368, 633-1368, 634-1368, 635-1368, 636-1368, 637-1368, 638-1368, 639-1368, 640-1368, 641-1368, 642-1368, 643-1368, 644-1368, 645-1368, 646-1368, 647-1368, 648-1368, 649-1368, 650-1368, or 651-1368 of spCas9. In some embodiments, the C-terminal portion of the split Cas9 protein comprises a portion of amino acids 574-1368 or 638-1368 of SpCas9.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

COBALT is used, for example, with the following parameters:
  a) alignment parameters: Gap penalties-11,-1 and End-Gap penalties-5,-1,
  b) CDD Parameters: Use RPS BLAST on; Blast E-value 0.003; Find Conserved columns and Recompute on, and
  c) Query Clustering Parameters: Use query clusters on; Word Size 4; Max cluster distance 0.8; Alphabet Regular.

EMBOSS Needle is used, for example, with the following parameters:
  a) Matrix: BLOSUM62;
  b) GAP OPEN: 10;
  c) GAP EXTEND: 0.5;
  d) OUTPUT FORMAT: pair;
  e) END GAP PENALTY: false;
  f) END GAP OPEN: 10; and
  g) END GAP EXTEND: 0.5.

The term "target site" refers to a sequence within a nucleic acid molecule that is modified by a nucleobase editor. In one embodiment, the target site is deaminated by a deaminase or a fusion protein comprising a deaminase (e.g., adenine deaminase).

As used herein, the terms "treat," "treating," "treatment," and the like refer to reducing or ameliorating a disorder and/or symptoms associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease and/or adverse symptom attributable to the disease. In some embodiments, the effect is preventative, i.e., the effect protects or prevents an occurrence or reoccurrence of a disease or condition. To this end, the presently disclosed methods comprise administering a therapeutically effective amount of a compositions as described herein.

By "uracil glycosylase inhibitor" or "UGI" is meant an agent that inhibits the uracil-excision repair system. In one embodiment, the agent is a protein or fragment thereof that binds a host uracil-DNA glycosylase and prevents removal of uracil residues from DNA. In an embodiment, a UGI is a protein, a fragment thereof, or a domain that is capable of inhibiting a uracil-DNA glycosylase base-excision repair enzyme. In some embodiments, a UGI domain comprises a wild-type UGI or a modified version thereof. In some embodiments, a UGI domain comprises a fragment of the exemplary amino acid sequence set forth below. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or 100% of the exemplary UGI sequence provided below. In some embodiments, a UGI comprises an amino acid sequence that is homologous to the exemplary UGI amino acid sequence or fragment thereof, as set forth below. In some embodiments, the UGI, or a portion thereof, is at least 70%, at least 75%, at least 80%, at least 85%, at least 90%, at least 95%, at least 96%, at least 97%, at least 98%, at least 99%, at least 99.5%, at least 99.9%, or 100% identical to a wild-type UGI or a UGI sequence, or portion thereof, as set forth below. An exemplary UGI comprises an amino acid sequence as follows:

```
>sp|P14739|UNGI_BPPB2 Uracil-DNA
glycosylase inhibitor
MTNLSDIIEKETGKQLVIQESILMLPEEVEEVIGNKPESDILV

HTAYDESTDENVMLLTSDAPEYKPWALVIQDSNGENKIKML
(SEQ ID NO: 76).
```

The term "vector" refers to a means of introducing a nucleic acid sequence into a cell, resulting in a transformed cell. Vectors include plasmids, transposons, phages, viruses, liposomes, and episome. "Expression vectors" are nucleic acid sequences comprising the nucleotide sequence to be expressed in the recipient cell. Expression vectors may include additional nucleic acid sequences to promote and/or facilitate the expression of the of the introduced sequence such as start, stop, enhancer, promoter, and secretion sequences.

Any compositions or methods provided herein can be combined with one or more of any of the other compositions and methods provided herein.

DNA editing has emerged as a viable means to modify disease states by correcting pathogenic mutations at the genetic level. Until recently, all DNA editing platforms have functioned by inducing a DNA double strand break (DSB) at a specified genomic site and relying on endogenous DNA repair pathways to determine the product outcome in a semi-stochastic manner, resulting in complex populations of genetic products. Though precise, user-defined repair outcomes can be achieved through the homology directed repair (HDR) pathway, a number of challenges have prevented high efficiency repair using HDR in therapeutically-relevant cell types. In practice, this pathway is inefficient relative to the competing, error-prone non-homologous end joining pathway. Further, HDR is tightly restricted to the G1 and S phases of the cell cycle, preventing precise repair of DSBs in post-mitotic cells. As a result, it has proven difficult or impossible to alter genomic sequences in a user-defined, programmable manner with high efficiencies in these populations.

BRIEF DESCRIPTION OF THE DRAWINGS

FIGS. 1A-1C depict plasmids. FIG. 1A is an expression vector encoding a TadA7.10-dCas9 base editor. FIG. 1B is a plasmid comprising nucleic acid molecules encoding proteins that confer chloramphenicol resistance (CamR) and spectinomycin resistance (SpectR). The plasmid also comprises a kanamycin resistance gene disabled by two point mutations. FIG. 1C is a plasmid comprising nucleic acid molecules encoding proteins that confer chloramphenicol resistance (CamR) and spectinomycin resistance (SpectR). The plasmid also comprises a kanamycin resistance gene disabled by three point mutations.

FIG. 2A is a schematic depicting a base editor with a guide RNA and a deaminase (e.g., TadA) for use on genomic DNA that has a protospacer and PAM sequence. FIG. 2B is a schematic depicting adenine deaminase (TadA) selection through directed evolution. FIG. 2C is an image of bacterial colonies transduced with the expression vectors depicted in FIGS. 1A-1C, which included a defective kanamycin resistance gene. The vectors contained ABE7.10 variants that were generated using error prone PCR. Bacterial cells expressing these "evolved" ABE7.10 variants were selected for kanamycin resistance using increasing concentrations of kanamycin. Bacteria expressing ABE7.10 variants having adenosine deaminase activity were capable of correcting the mutations introduced into the kanamycin resistance gene, thereby restoring kanamycin resistance. The kanamycin resistant cells were selected for further analysis.

FIG. 3A is a drawing of a portion of the regulatory region for the HGB1 gene. FIG. 3A discloses SEQ ID NO: 383. FIG. 3B quantifies the efficiency and specificity of adenosine deaminase variants listed in Table 6. Editing is assayed at the hemoglobin subunit gamma 1 (HGB1) locus in HEK293T cells, which is therapeutically relevant site for upregulation of fetal hemoglobin. The top panel depicts nucleotide residues in the target region of the regulatory sequence of the HGB1 gene. A5, A8, A9, and A11 denote the edited adenosine residues in HGB1. FIG. 3B discloses SEQ ID NO: 384.

FIG. 4 discloses SEQ ID NOS 385-386, respectively, in order of appearance.

FIG. 5 discloses SEQ ID NOS 387-388, respectively, in order of appearance.

FIG. 7A illustrates an overview of adenine base editing: i) ABE8 creates an R-loop at a sgRNA-targeted site in the genome; ii) TadA* deaminase chemically converts adenine to inosine via hydrolytic deamination on the ss-DNA portion of the R-loop; iii) D10A nickase of Cas9 nicks the strand opposite of the inosine containing strand; iv) the inosine containing strand can be used as a template during DNA replication; v) inosine preferentially base pairs with cytosine in the context of DNA polymerases; and vi) following replication, inosine may be replaced by guanosine. FIG. 7B illustrates the architecture of ABE8.x-m and ABE8.x-d. The nomenclature for ABE8.x-m/d is as follows: ABE8s are adenine base editors developed from an additional round of evolution (round 8) proceeding ABE7.10 evolution campaign (7 iterations of evolution conducted (Gaudelli, N. M. et al. Programmable base editing of A*T to G*C in genomic DNA without DNA cleavage. Nature 551, 464-471, doi: 10.1038/nature24644 (2017)). The "x" numerical value of ABE8.x indicates which mutations are included in the evolved TadA protomer of the corresponding ABE8 editor; each number represents a different set of mutations described in Table 9. The indication of "m" or "d" denotes whether the ABE8 construct contains either an N-terminal wild-type TadA linked to the evolved TadA ("d") or contains the TadA evolved variant only ("m"). FIG. 7C is a graph depicting the percentage of variant amino acids to amino acid position in a synthetic library of TadA*7.10 background mutations. FIG. 7D is a schematic that illustrates three perspectives (i.e., overview, active site, and C-terminal α-helix) of the E. coli TadA deaminase (PDB 1Z3A) aligned with the S. aureus TadA (not shown) complexed with tRNAArg2 (PDB 2B3J). Mutations identified in eighth round of evolution are highlighted. Key residues throughout ABE8 and the active site are labeled. The region of the C-terminal alpha helix is highlighted. FIG. 7E are graphs depicting A•T to G•C base editing efficiencies of core ABE8 constructs relative to ABE7.10 constructs in Hek293T cells across eight genomic sites. Values and error bars reflect the mean and s.d. of three independent biological replicates performed on different days.

FIG. 8A is a graph depicting A•T to G•C conversion in Hek293T cells with NG-Cas9 ABE8s (-NG PAM). FIG. 8B is a graph depicting A•T to G•C conversion in Hek293T cells with Sa-Cas9 ABE8s (-NNGRRT PAM). FIG. 8C is a graph depicting A•T to G•C conversion in Hek293T cells with catalytically inactivated, dCas9-ABE8s (D10A, H840A in S. pyogenes Cas9).

FIGS. 9A and 9B are graphs that depict on-target DNA editing frequencies. FIGS. 9C and 9D are graphs that depict sgRNA-guided DNA-off-target editing frequencies. FIGS. 9E and 9F are graphs depicting RNA off-target editing frequencies.

FIGS. 10A and 10C are heat maps depicting A•T to G•C median editing conversion across 8 genomic sites. FIGS. 10B and 10D are heat maps depicting INDEL formation. Delta residue value corresponds to deletion position in TadA. Median value generated from n=3 biological replicate.

Figure 19A:
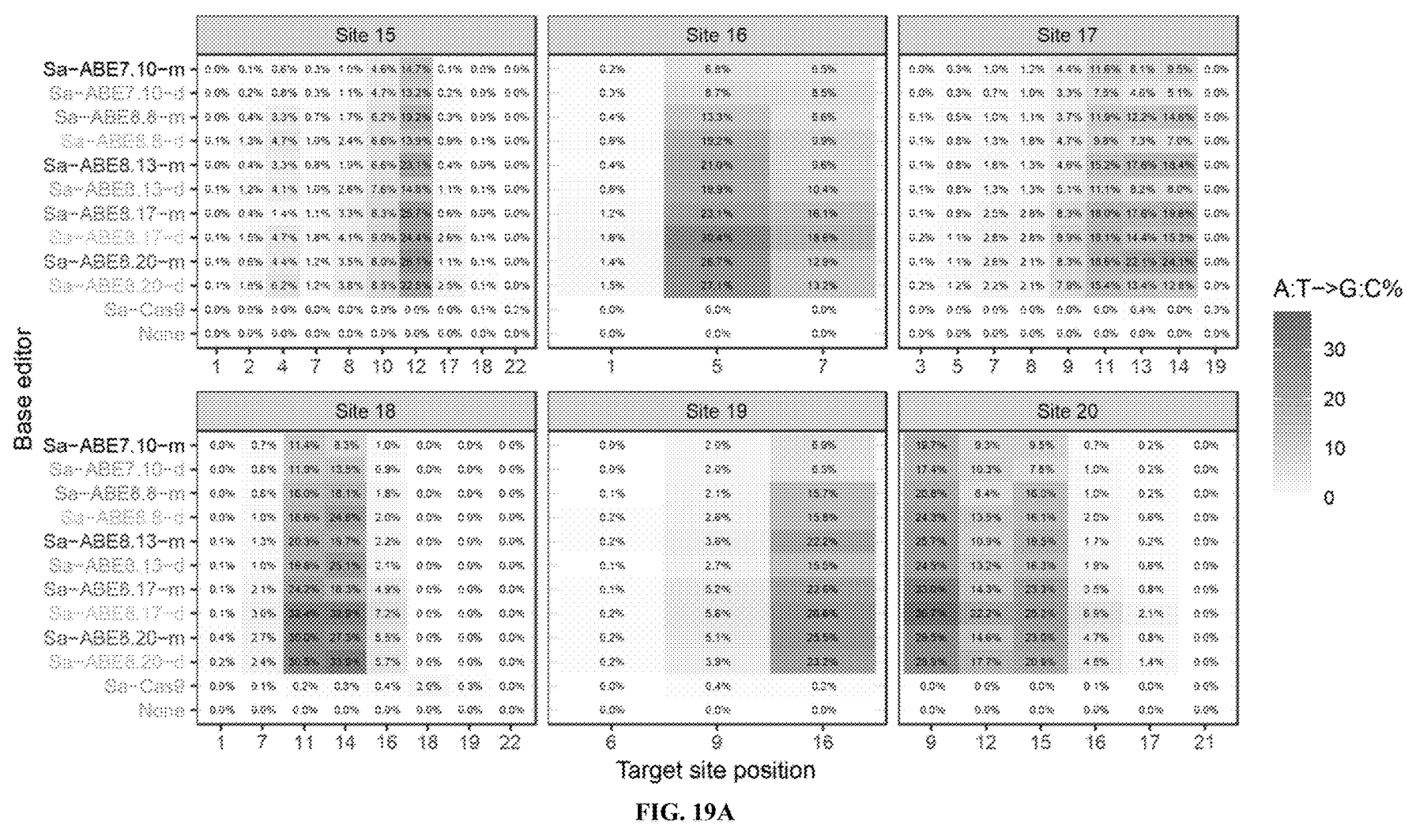
Figure 19B:
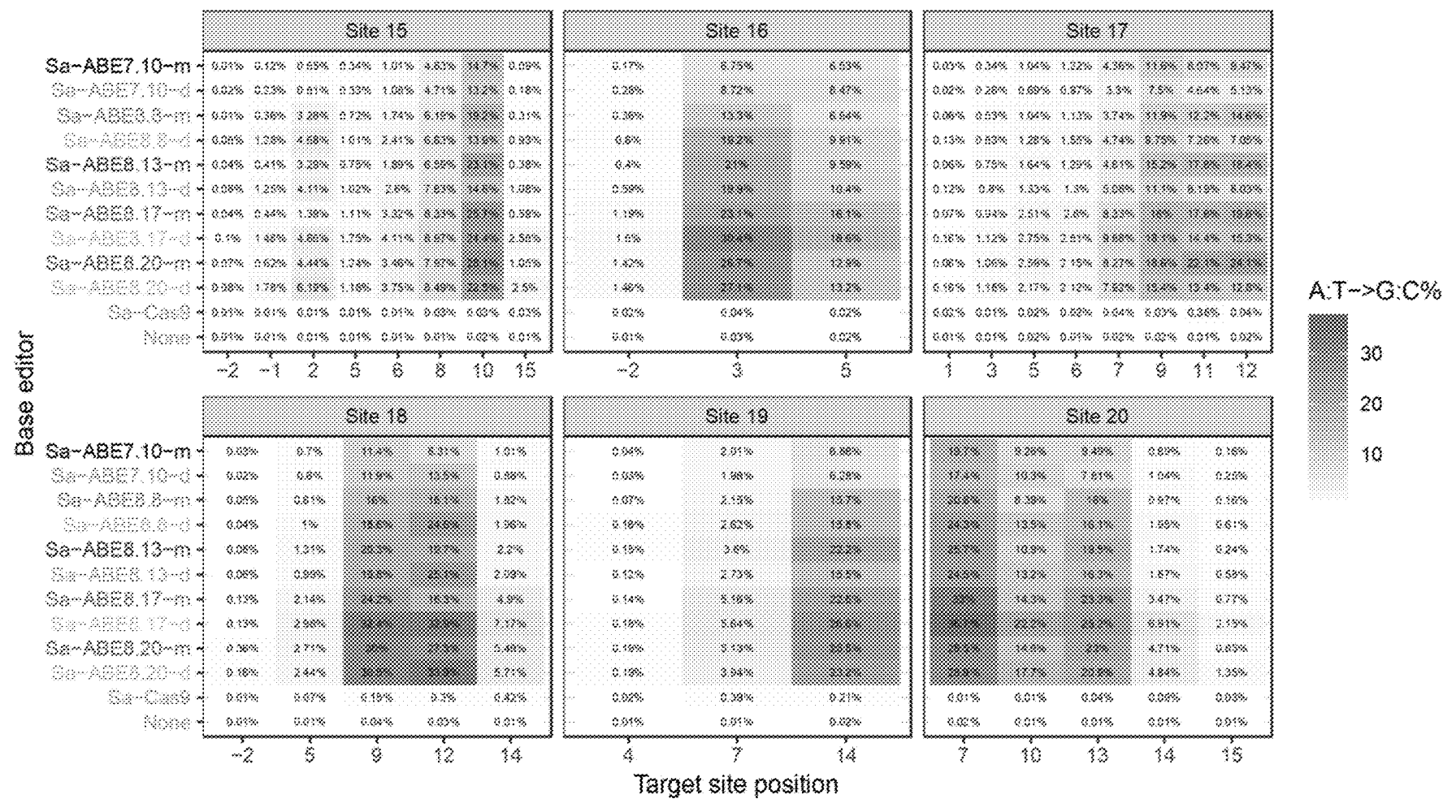

FIGS. 19A and 19B are heat maps depicting median A•T to G•C conversion of core Sa-ABE8 constructs (-NNGRRT PAM) at six genomic sites in HEK293T cells. Site positions are numbered −2 to 20 (5' to 3') within the 22-nt protospacer. Position 20 is 5' to the NNGRRT PAM. Median values were generated from n=3 biological replicates.

FIGS. 23A and 23C are heat maps depicting INDEL frequencies shown for dC9-ABE8-m variants relative to ABE7.10. FIGS. 23B and 23D are heat maps depicting INDEL frequencies shown for dC9-ABE8-d variants relative to ABE7.10.

FIG. 24 (top) is a box plot depicting editing frequencies for each site averaged across all 'C' positions within the target. Cytosines within the protospacer are indicted with shading. The boundaries of the box indicate the first (bottom) and third (top) quartiles, while the band within the box indicates the median. Values that are farther than 1.5 times the interquartile range (|Q3-Q1|) from the median are marked as outliers and displayed individually. Whiskers extend from the edge of the box to the maximum and minimum values that are not considered outliers. FIG. 24 (bottom) is a table indicating the site and target DNA sequence. FIG. 24 discloses SEQ ID NOS 389-394, respectively, in order of appearance.

FIGS. 25A-25H depict DNA on-target and sgRNA-dependent DNA off-target editing by ABE8 constructs and ABE8 constructs with TadA mutations to improve specificity for DNA. Individual data points are shown and error bars represent s.d. for n=3 independent biological replicates, performed on different days. FIGS. 25A and 25B are graphs depicting on-target DNA editing frequencies for core ABE8 constructs as compared to ABE7. FIGS. 25C and 25D are graphs depicting on-target DNA editing frequencies for ABE8 constructions at four genomic loci that improve RNA off-target editing. FIGS. 25E and 25F are graphs depicting sgRNA-guided DNA-off-target editing frequencies for ABE8 constructs as compared to ABE7. FIGS. 25G and 25H are graphs depicting off-target DNA editing frequencies for ABE8 constructs at known, sgRNA-dependent loci known to improve RNA off-target editing.

FIG. 27A is a schematic depicting the genomic base editing sites for HBG1/2. FIG. 27B is a graph depicting A•T to G•C conversion at −198 HBG1/2 site in CD34+ cells treated with ABE from two separate donors. NGS analysis conducted at 48 and 144h post treatment. −198 HBG1/2 target sequence shown with $A_7$ highlighted. Percent A•T to G•C plotted for $A_7$. FIG. 27B discloses SEQ ID NO: 395. FIG. 27C is a graph depicting percentage of γ-globin formed as a fraction of α-globin in erythrocytes derived from ABE treated cells. Values shown from two different donors, post ABE treatment and erythroid differentiation.

FIG. 28A is a heat map depicting A to G editing frequency of ABE8s in CD34+ cells from two donors, where Donor 2 is heterozygous for sickle cell disease, at 48 and 144h post editor treatment. FIG. 28B is a graphical representation of distribution of total sequencing reads, which contain either $A_7$ only edits or combined $(A_7+A_8)$ edits.

FIG. 51A is a graph depicting an average of ABE8.8 editing in 2 healthy donors in 2 independent experiments. Editing efficiency was measured with primers that distinguish HBG1 and HBG2. FIG. 51B is a graph depicting an average of 1 healthy donor in 2 independent experiments. Editing efficiency was measured with primers that recognize both HBG1 and HBG2. FIG. 51C is a graph depicting editing of ABE8.8 in a donor with heterozygous E6V mutation. FIGS. 51D and 51E are graphs depicting gamma globin increase in the ABE8.8 edited cells.

FIG. 52A is a graph depicting a screen of different editor variants with about 70% editing in SCD patient fibroblasts. FIG. 52B is a graph depicting CD34 cells from healthy donors edited with a lead ABE variant, targeting a synonymous mutation A13 in an adjacent proline that resides within the editing window and serves as a proxy for editing the SCD mutation. ABE8 variants showed an average editing frequency around 40% at the proxy A13.

FIG. 53A is a graph depicting A-to-I editing frequencies in targeted RNA amplicons for core ABE 8 constructs as compared to ABE7 and Cas9 (D10A) nickase control. FIG. 53B is a graph depicting A-to-I editing frequencies in targeted RNA amplicons for ABE8 with mutations that have been reported to improve RNA off-target editing. FIG. 53C is a graph depicting the maximum level of A-to-I mutation in cellular mRNA samples isolated from cells treated with the indicated construct.

FIGS. 54A and 54B depict absolute and fold changes in base editing between ABE8 and ABE7. Representation of average ABE8:ABE7 A•T to G•C editing in Hek293T cells across all 'A' positions within the target of eight different genomic sites. Positions 2-12 denote location of a target adenine within the 20-nt protospacer with position 20 directly 5' of the -NGG PAM. Each point is shown as a comparison to the median value for ABE7.10 editors at the same site and position (FIG. 54A) The absolute difference (ABE8-ABE7) in editing at each position is shown (FIG. 54B). The ratio of ABE8:ABE7 editing is shown. FIG. 54C (top) is a schematic depicting ABE7.10 and ABE8 editor activity windows. Numbers indicate the position within the protospacer. The location of an induced nick in the target DNA backbone is indicated by a triangle and corresponding PAM recognition sequence is shown. FIG. 54C (bottom) is a heat map depicting the comparison of targetable sites, ABE7 vs. ABE8. Each box shows the number and percentage of pathogenic G→A or C→T SNV variants in the ClinVar database (Landrum, M. J. et al. ClinVar: public archive of interpretations of clinically relevant variants. Nucleic Acids Res 44, D862-868, doi:10.1093/nar/gkv1222 (2016); Landrum, M. J. et al. ClinVar: public archive of relationships among sequence variation and human phenotype. Nucleic Acids Res 42, D980-985, doi:10.1093/nar/gktl 113 (2014)) that can be targeted with ABE7 or ABE8. The analysis considers a 20-nt protospacer sequence and a Cas9 that can target NGG or NGA PAMs. The editing windows were assumed to be 5-7 for ABE7 and 4-8 for ABE8. Precise correction implies that only the pathogenic mutation was editable within the specified window in at least one possible spacer/PAM combination. If all possible correction strategies involve other modified bases modified, the corresponding variants are counted in the "with bystander" category.

FIGS. 55A and 55B are heat maps depicting on-target DNA editing frequencies for core ABE 8 constructs as compared to ABE7. Constructs were delivered as plasmid (FIG. 55A) and as mRNA (FIG. 55B). FIGS. 55C and 55D are heat maps depicting sgRNA-dependent off-target DNA editing frequencies for ABE8 as compared to ABE8. Constructs were delivered as plasmid (FIG. 55C) and as mRNA (FIG. 55D). FIG. 55E are heat maps depicting the maximum A-to-G editing frequency measured in a 125-nt region of the indicated amplicon. Constructs were delivered as plasmid (left) and as mRNA (right).

Figure 55A:
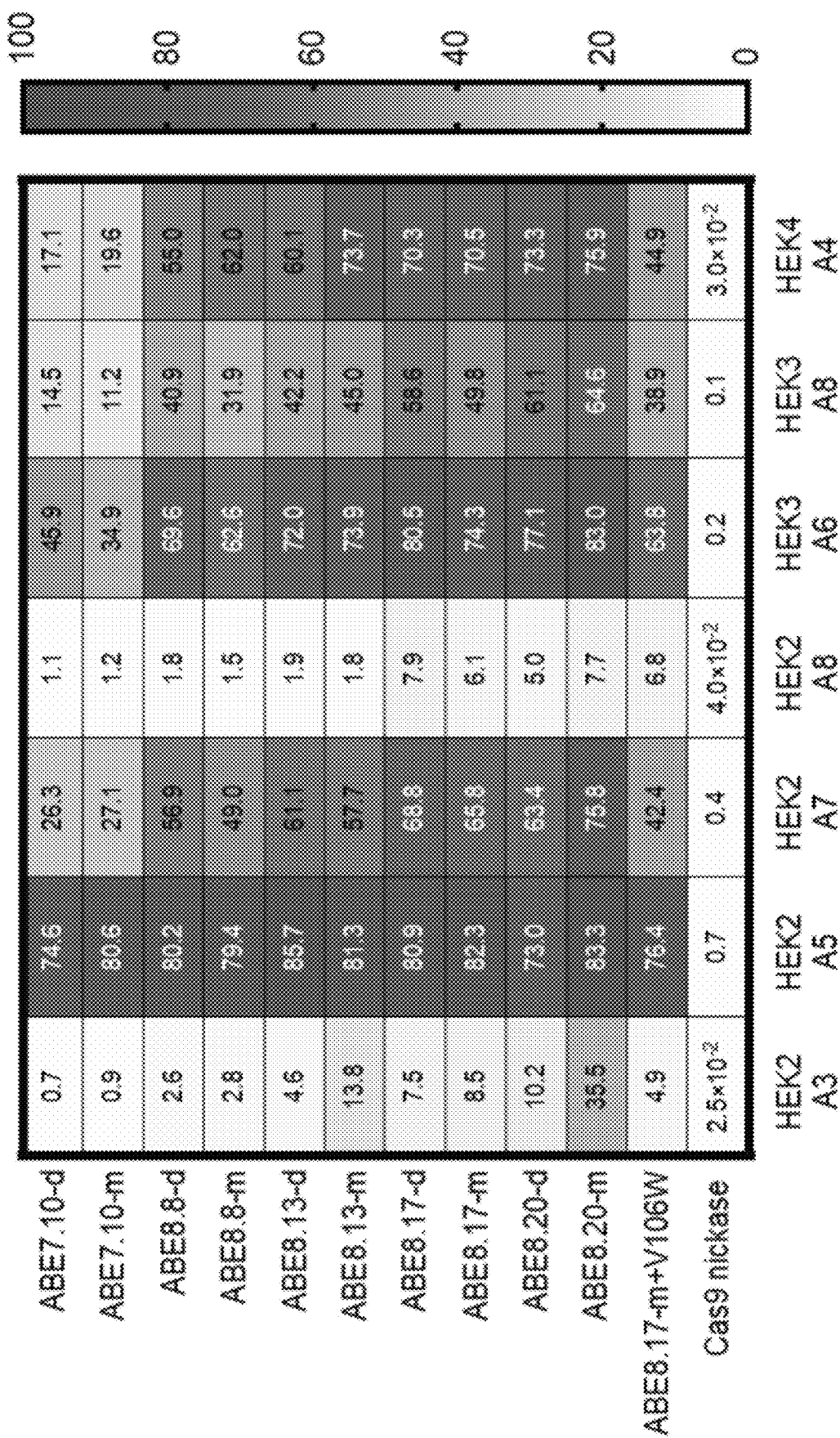
FIGS. 55A-55E depict DNA on-target base editing, sgRNA-dependent DNA off-target base editing and sgRNA-independent off-target mRNA editing by ABE8 constructs using plasmid or mRNA delivery.
Figure 55B:
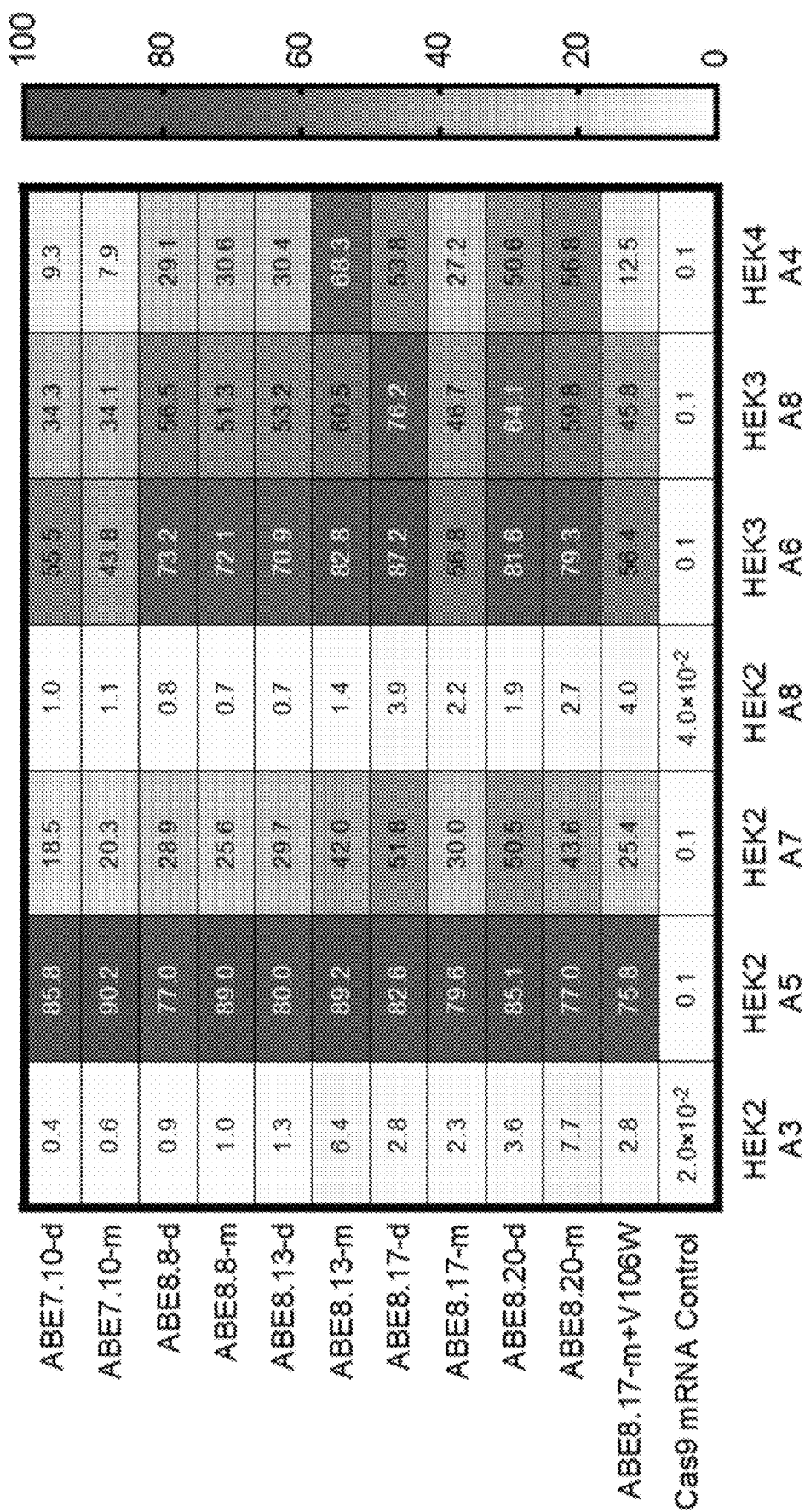
Figure 55C:
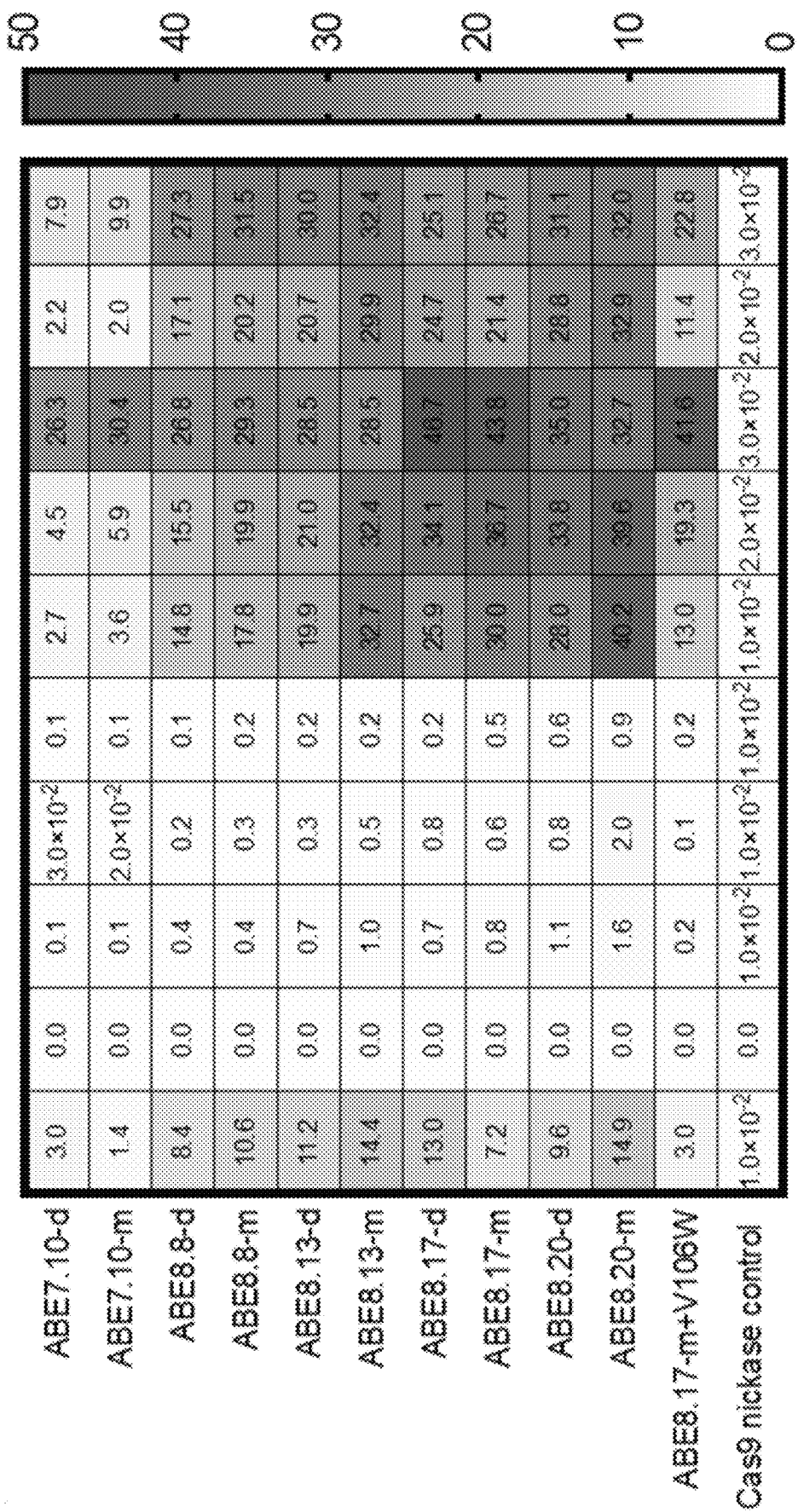
Figure 55D:
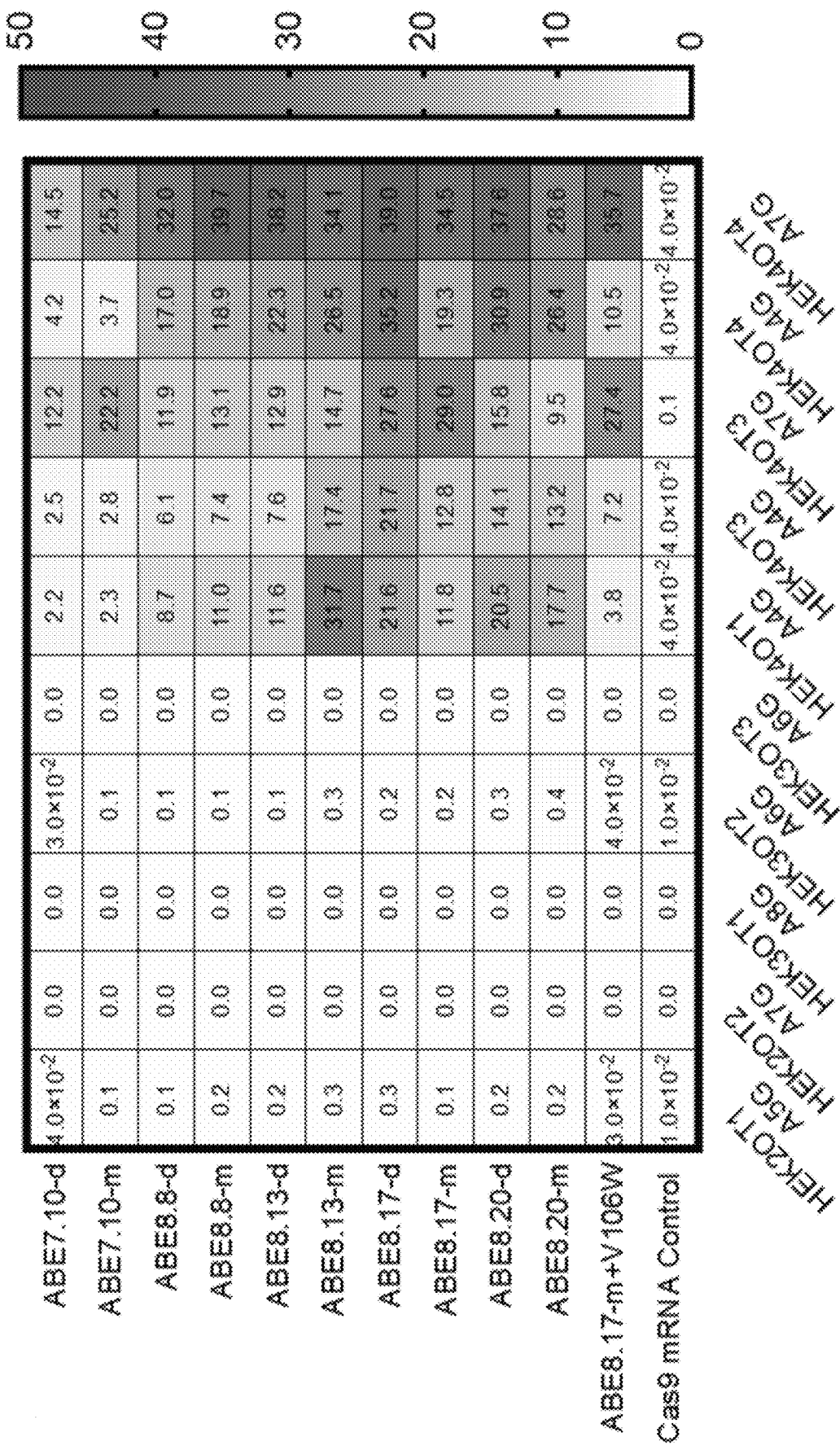
Figure 55E:
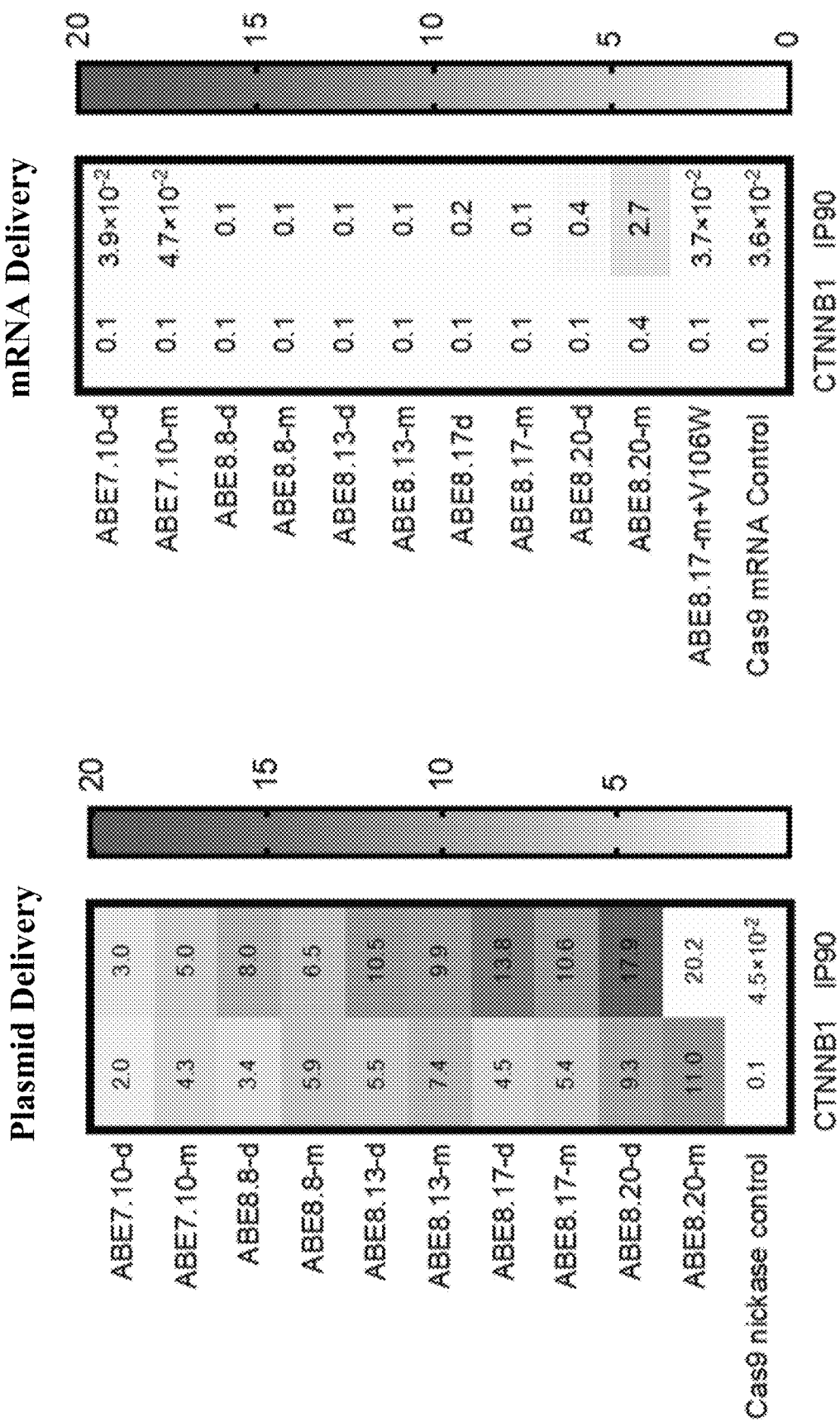

The median is shown for n=3 or n=4 independent biological replicates, performed on different days, other than in FIG. 55D, where some samples yielded <5,000 Miseq reads so were excluded; specifically, HEK4OT3 (ABE7.10-d n=1 and ABE8.13-m n=2) and HEK4OT4 (ABE8.13-d, ABE8.17-d, ABE8.20-m and ABE8.20-d n=2) and in FIG. 55E (right) which ABE8.8-m: n=2 for CTNNB1.

Figure 56:
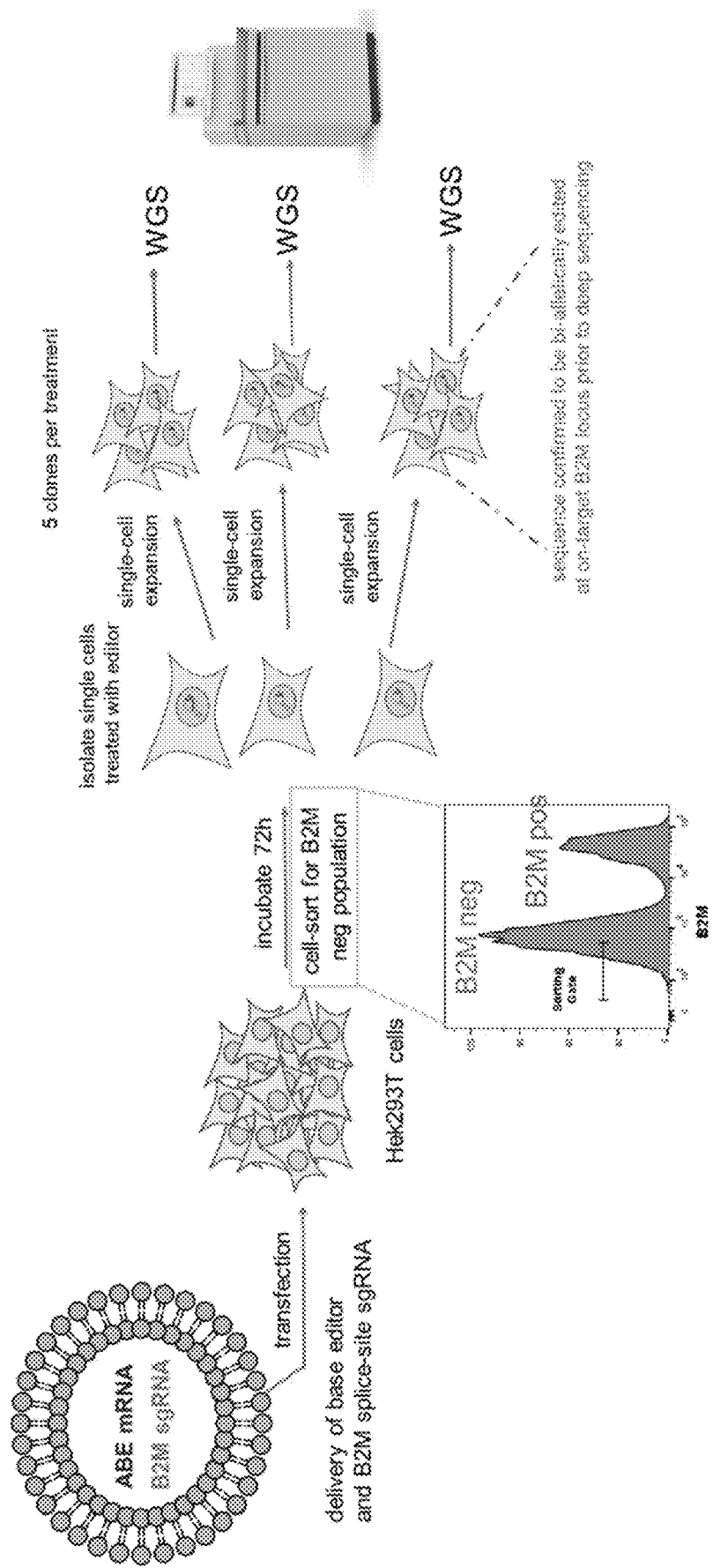

FIG. 56 is a schematic depicting ABE8 guide-independent DNA off-target analysis.

Figure 57:
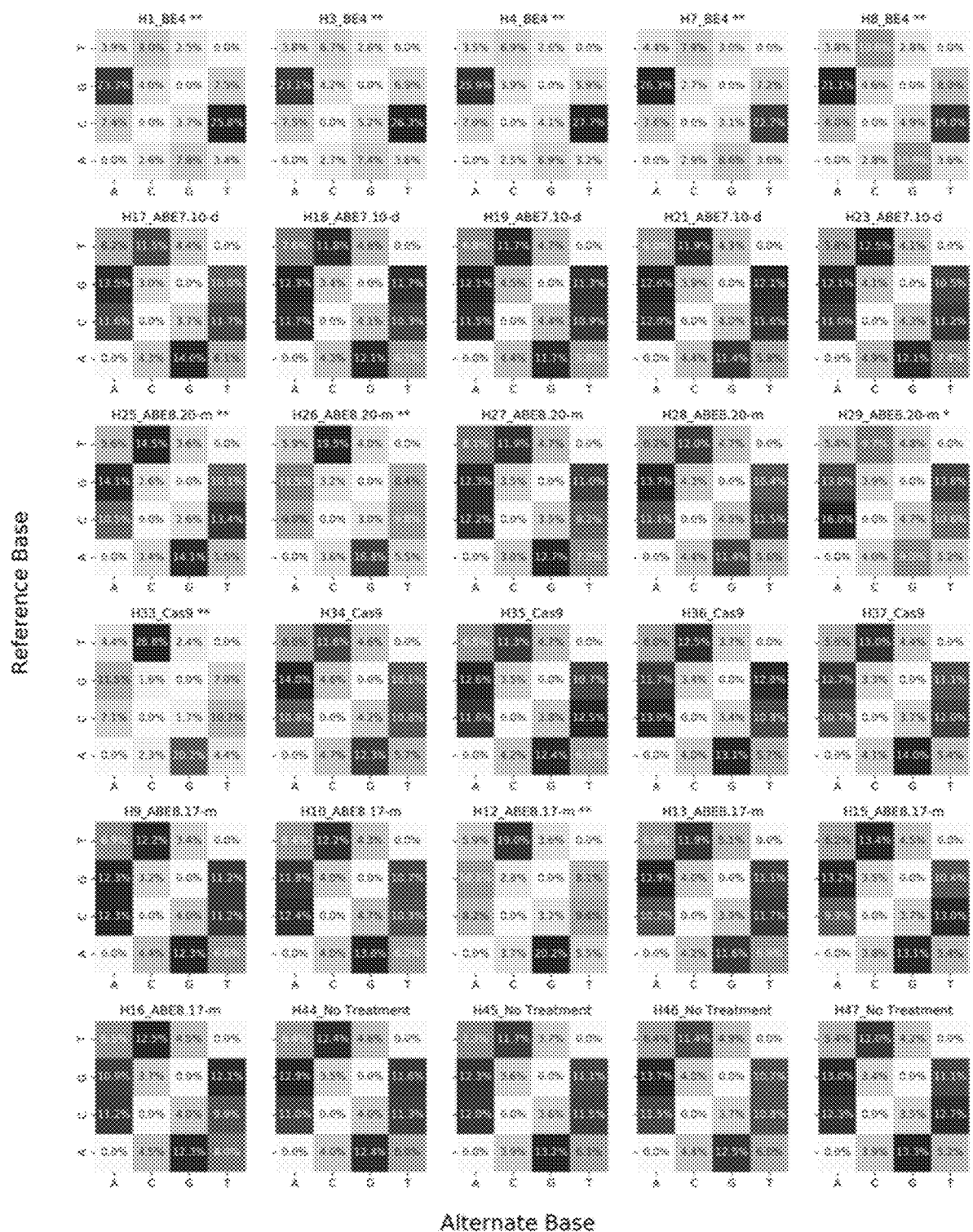

FIG. 57 depicts mutational classification plots for each sample sent for whole genome sequencing. Distribution of mutation types in all whole genome sequenced samples. Samples significantly enriched for mutations of the type the base editor creates indicated with **. Sample with significantly less mutations of the type the editor creates indicated with *.

Figure 58:
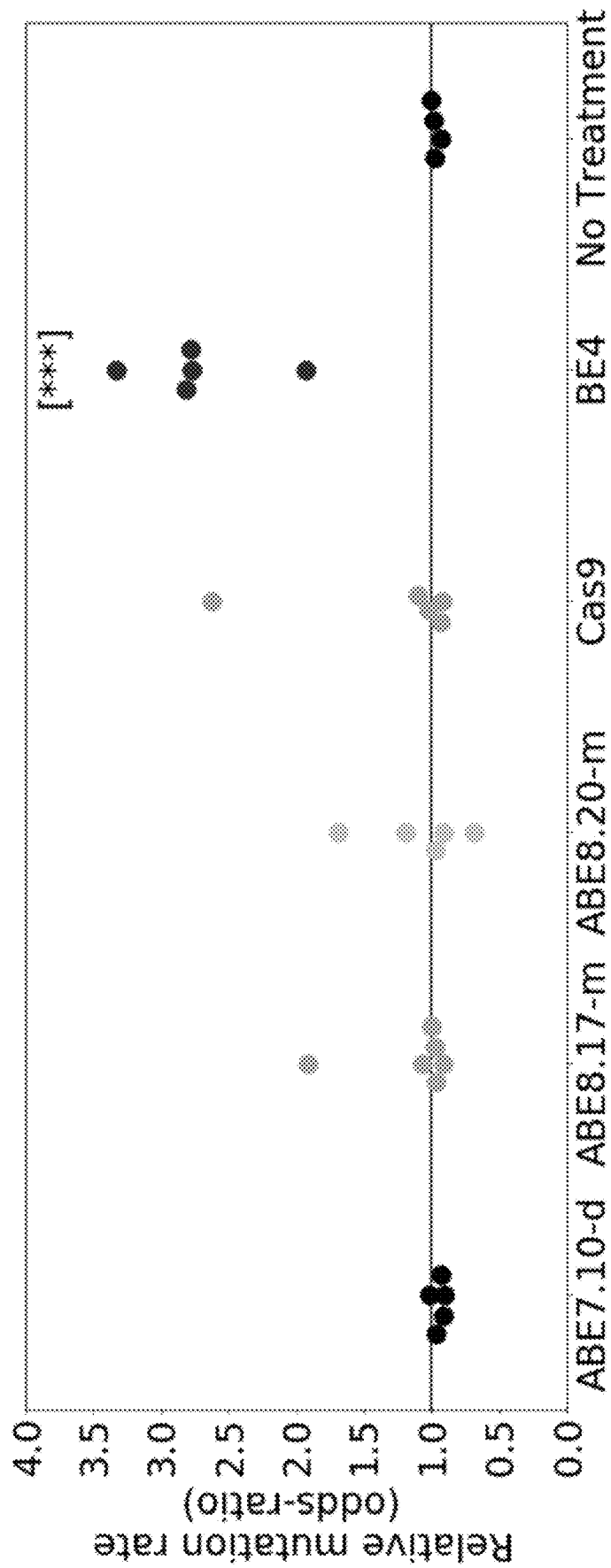

FIG. 58 is a graph depicting whole transcriptome and whole genome sequencing data from cells treated with base editor mRNAs. For each editor, the odds ratios quantify the fold change in mutation frequencies for the editor-induced mutation type (C-to-T for BE4 and A-to-G for others) and all other mutation types in each treatment replicate compared to an untreated control. [***] indicates a significant p-value (<0.05) for a one-sided Mann-Whitney U test between treatment group and untreated control group.

Figure 59A:
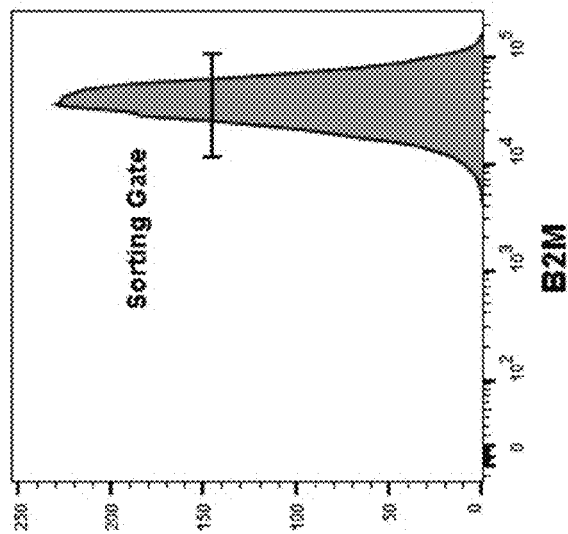
Figure 59A:
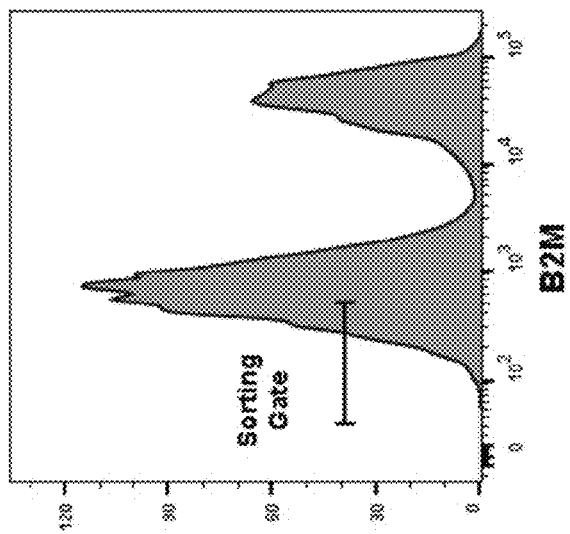
Figure 59B:
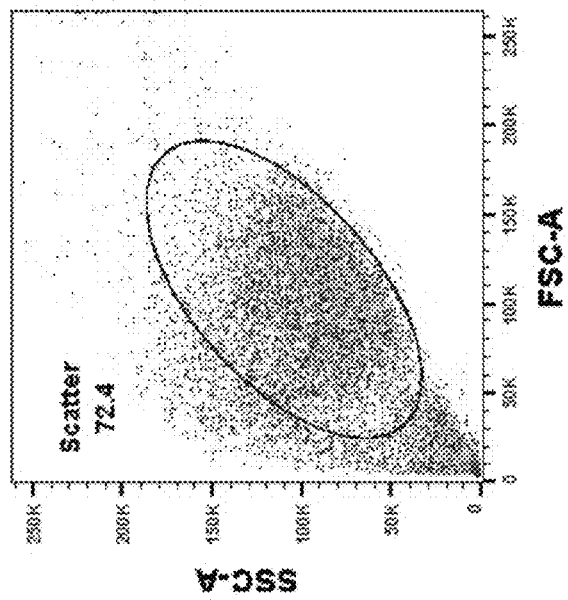
Figure 59B:
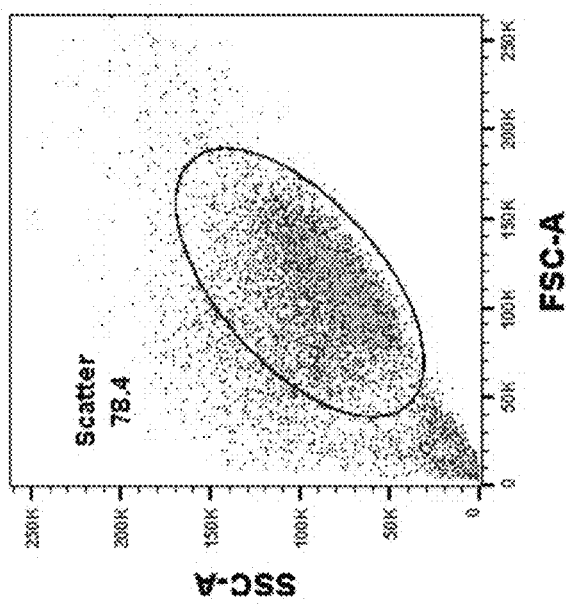

FIGS. 59A and 59B depict representative examples of gates used to flow sort B2M-positive and B2M-negative cells prior to whole genome sequencing. FIG. 59A depicts a representative plot and gate for live, B2M-positive HEK293T cells sorted into single cell clones for the untreated condition. FIG. 59B depicts a representative plot and gate for live, B2M-negative HEK293T cells sorted for the all treated conditions (ABE, CBE or Cas9-treated cells).

Figure 60:
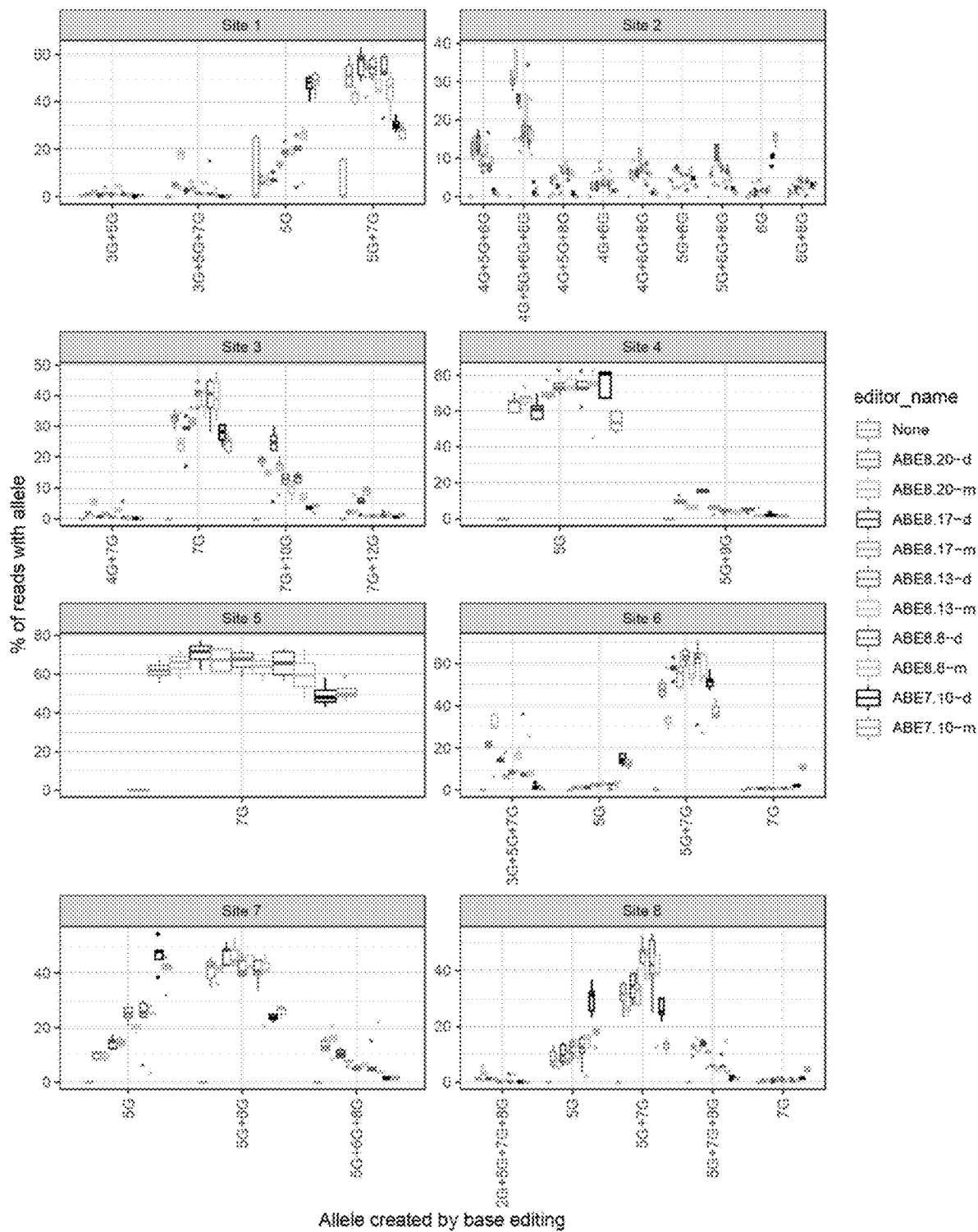

FIG. 60 are graphs depicting alleles created by ABEs across 8 different genomic sites in HEK293T cells.

Figure 61:
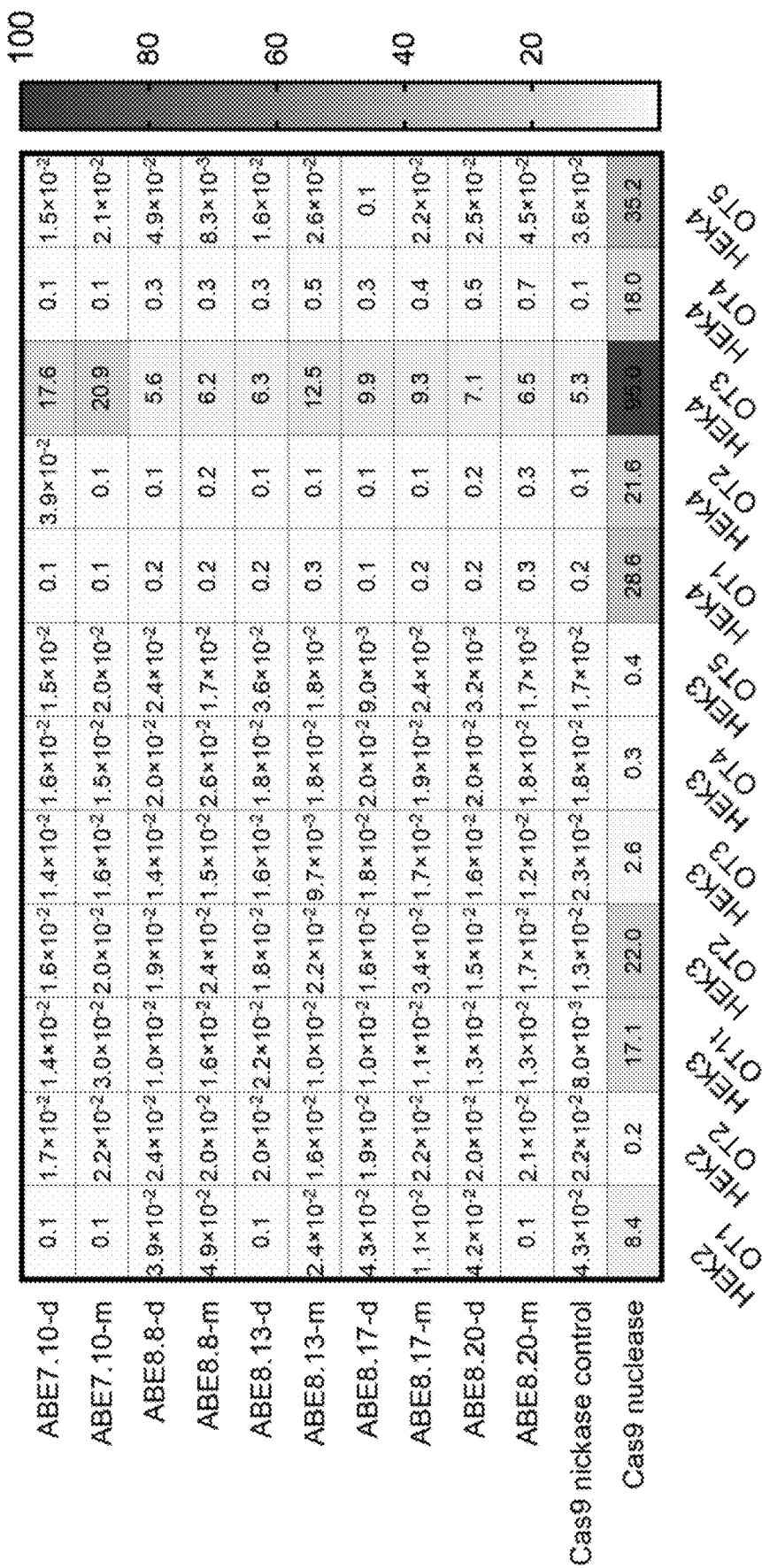

FIG. 61 is a heat map depicting median INDEL frequencies at 12 previously identified sgRNA-dependent Cas9 off-target loci in human cells. Data shown is the median value from n=3 independent biological replicates, performed on different days. Constructs were administered to HEK293T cells using plasmid delivery.

Figure 62:
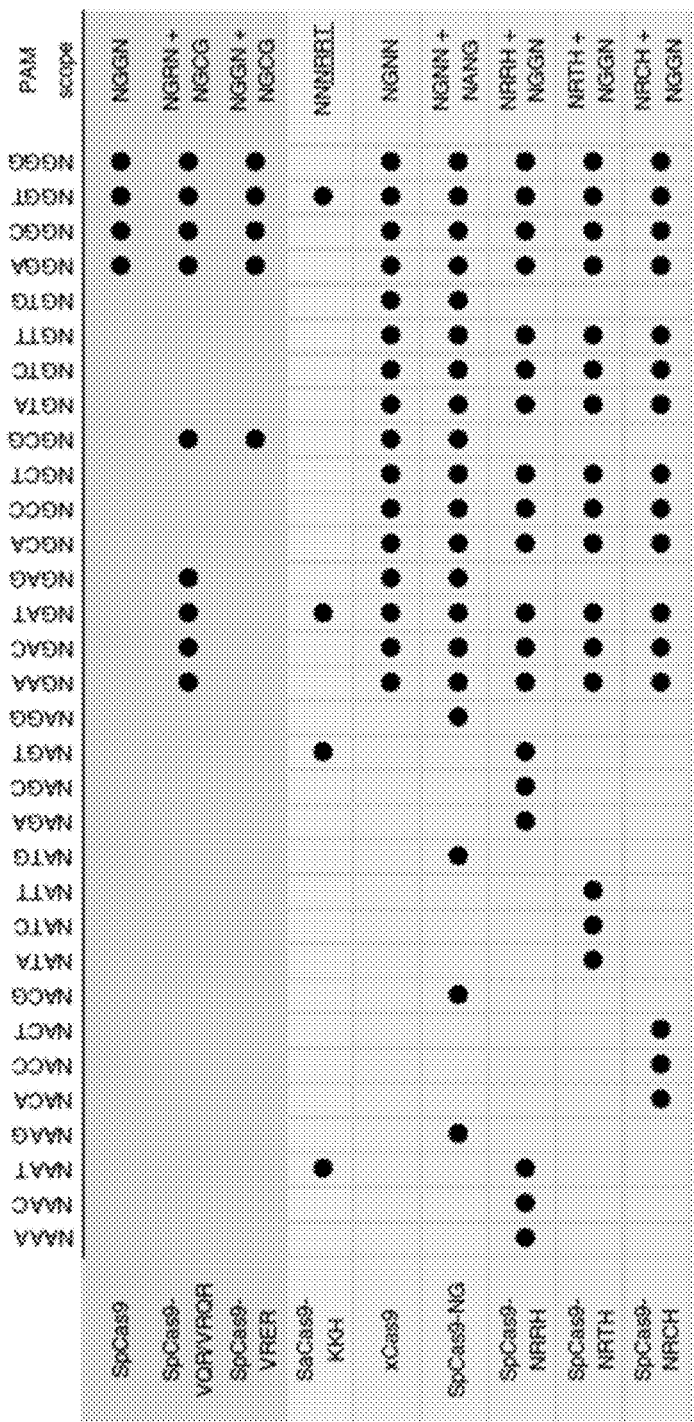

FIG. 62 is a table depicting Cas9 variants for accessing all possible PAMs for NRNN PAM. Only Cas9 variants that require recognition of three or fewer defined nucleotides in their PAMs are listed. The non-G PAM variants include SpCas9-NRRH, SpCas9-NRTH, and SpCas9-NRCH.

DETAILED DESCRIPTION

The disclosure provides compositions comprising novel adenine base editors (e.g., ABE8) that have increased efficiency and methods of using them to generate modifications in target nucleobase sequences.

Nucleobase Editor

Disclosed herein is a base editor or a nucleobase editor for editing, modifying or altering a target nucleotide sequence of a polynucleotide. Described herein is a nucleobase editor or a base editor comprising a polynucleotide programmable nucleotide binding domain and a nucleobase editing domain (e.g., adenosine deaminase). A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

Polynucleotide Programmable Nucleotide Binding Domain

It should be appreciated that polynucleotide programmable nucleotide binding domains can also include nucleic acid programmable proteins that bind RNA. For example, the polynucleotide programmable nucleotide binding domain can be associated with a nucleic acid that guides the polynucleotide programmable nucleotide binding domain to an RNA. Other nucleic acid programmable DNA binding proteins are also within the scope of this disclosure, though they are not specifically listed in this disclosure.

A polynucleotide programmable nucleotide binding domain of a base editor can itself comprise one or more domains. For example, a polynucleotide programmable nucleotide binding domain can comprise one or more nuclease domains. In some embodiments, the nuclease domain of a polynucleotide programmable nucleotide binding domain can comprise an endonuclease or an exonuclease. Herein the term "exonuclease" refers to a protein or polypeptide capable of digesting a nucleic acid (e.g., RNA or DNA) from free ends, and the term "endonuclease" refers to a protein or polypeptide capable of catalyzing (e.g., cleaving) internal regions in a nucleic acid (e.g., DNA or RNA). In some embodiments, an endonuclease can cleave a single strand of a double-stranded nucleic acid. In some embodiments, an endonuclease can cleave both strands of a double-stranded nucleic acid molecule. In some embodiments a polynucleotide programmable nucleotide binding domain can be a deoxyribonuclease. In some embodiments a polynucleotide programmable nucleotide binding domain can be a ribonuclease.

In some embodiments, a nuclease domain of a polynucleotide programmable nucleotide binding domain can cut zero, one, or two strands of a target polynucleotide. In some embodiments, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g., DNA). In some embodiments, a nickase can be derived from a fully catalytically active (e.g., natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D10A mutation and a histidine at position 840. In such embodiments, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g., natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

The amino acid sequence of an exemplary catalytically active Cas9 is as follows:

```
MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS
```

-continued

```
HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 1).
```

A base editor comprising a polynucleotide programmable nucleotide binding domain comprising a nickase domain is thus able to generate a single-strand DNA break (nick) at a specific polynucleotide target sequence (e.g., determined by the complementary sequence of a bound guide nucleic acid). In some embodiments, the strand of a nucleic acid duplex target polynucleotide sequence that is cleaved by a base editor comprising a nickase domain (e.g., Cas9-derived nickase domain) is the strand that is not edited by the base editor (i.e., the strand that is cleaved by the base editor is opposite to a strand comprising a base to be edited). In other embodiments, a base editor comprising a nickase domain (e.g., Cas9-derived nickase domain) can cleave the strand of a DNA molecule which is being targeted for editing. In such embodiments, the non-targeted strand is not cleaved.

Also provided herein are base editors comprising a polynucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g., RuvC1 and/or HNH domains). In further embodiments, a catalytically dead polynucleotide programmable nucleotide binding domain comprises a point mutation (e.g., D10A or H840A) as well as a deletion of all or a portion of a nuclease domain.

Also contemplated herein are mutations capable of generating a catalytically dead polynucleotide programmable nucleotide binding domain from a previously functional version of the polynucleotide programmable nucleotide binding domain. For example, in the case of catalytically dead Cas9 ("dCas9"), variants having mutations other than D10A and H840A are provided, which result in nuclease inactivated Cas9. Such mutations, by way of example, include other amino acid substitutions at D10 and H840, or other substitutions within the nuclease domains of Cas9 (e.g., substitutions in the HNH nuclease subdomain and/or the RuvC1 subdomain). Additional suitable nuclease-inactive dCas9 domains can be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN). In some embodiments, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid. Such a protein is referred to herein as a "CRISPR protein." Accordingly, disclosed herein is a base editor comprising a polynucleotide programmable nucleotide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below a CRISPR protein-derived domain can comprise one or more mutations, insertions, deletions, rearrangements and/or recombinations relative to a wild-type or natural version of the CRISPR protein.

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems, correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, and then trimmed 3'-5' exonucleolytically. In nature, DNA-binding and cleavage typically requires protein and both RNAs. However, single guide RNAs ("sgRNA," or simply "gRNA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish self versus non-self.

In some embodiments, the methods described herein can utilize an engineered Cas protein. A guide RNA (gRNA) is a short synthetic RNA composed of a scaffold sequence necessary for Cas-binding and a user-defined ~20 nucleotide spacer that defines the genomic target to be modified. Thus, a skilled artisan can change the genomic target of the Cas protein specificity is partially determined by how specific the gRNA targeting sequence is for the genomic target compared to the rest of the genome.

In some embodiments, the gRNA scaffold sequence is as follows:

```
GUUUUAGAGC UAGAAAUAGC AAGUUAAAAU AAGGCUAGUC

CGUUAUCAAC UUGAAAAAGU GGCACCGAGU CGGUGCUUUU
(SEQ ID NO: 77).
```

In some embodiments, a CRISPR protein-derived domain incorporated into a base editor is an endonuclease (e.g., deoxyribonuclease or ribonuclease) capable of binding a target polynucleotide when in conjunction with a bound guide nucleic acid. In some embodiments, a CRISPR protein-derived domain incorporated into a base editor is a nickase capable of binding a target polynucleotide when in conjunction with a bound guide nucleic acid. In some embodiments, a CRISPR protein-derived domain incorporated into a base editor is a catalytically dead domain capable of binding a target polynucleotide when in conjunction with a bound guide nucleic acid. In some embodiments, a target polynucleotide bound by a CRISPR protein derived domain of a base editor is DNA. In some embodiments, a target polynucleotide bound by a CRISPR protein-derived domain of a base editor is RNA.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2c1, Cas12c/C2c3, Cas12d/CasY, Cas12e/CasX, Cas12g, Cas12h, and Cas12i, CARF, DinG, homologues thereof, or modified versions thereof. An unmodified CRISPR enzyme can have DNA cleavage activity, such as Cas9, which has two functional endonuclease domains: RuvC and HNH. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used. Cas9 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., Cas9 from S. pyogenes). Cas9 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., from S. pyogenes). Cas9 can refer to the wild-type or a modified form of the Cas9 protein that can comprise an amino acid change such as a deletion, insertion, substitution, variant, mutation, fusion, chimera, or any combination thereof.

In some embodiments, a CRISPR protein-derived domain of a base editor can include all or a portion of Cas9 from Corynebacterium ulcerans (NCBI Refs: NC_015683.1, NC_017317.1); Corynebacterium diphtheria (NCBI Refs: NC_016782.1, NC_016786.1); Spiroplasma syrphidicola (NCBI Ref: NC_021284.1); Prevotella intermedia (NCBI Ref: NC_017861.1); Spiroplasma taiwanense (NCBI Ref: NC_021846.1); Streptococcus iniae (NCBI Ref: NC_021314.1); Belliella baltica (NCBI Ref: NC_018010.1); Psychroflexus torquis (NCBI Ref: NC_018721.1); Streptococcus thermophilus (NCBI Ref: YP_820832.1); Listeria innocua (NCBI Ref: NP_472073.1); Campylobacter jejuni (NCBI Ref: YP_002344900.1); Neisseria meningitidis (NCBI Ref: YP_002342100.1), Streptococcus pyogenes, or Staphylococcus aureus.

Cas9 domains of Nucleobase Editors

Cas9 nuclease sequences and structures are well known to those of skill in the art (See, e.g., "Complete genome sequence of an M1 strain of Streptococcus pyogenes." Ferretti et al., J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, S. pyogenes and S. thermophilus. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In some embodiments, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain (dCas9), or a Cas9 nickase (nCas9). In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9.

In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, Cas12b/C2C1, and Cas12c/C2C3. In some embodiments, wild-type Cas9 corresponds to Cas9 from *Streptococcus pyogenes* (NCBI Reference Sequence: NC_017053.1, nucleotide and amino acid sequences as follows).

```
ATGGATAAGAAATACTCAATAGGCTTAGATATCGGCACAAATAGCGTCGGATGGGCGGTGAT

CACTGATGATTATAAGGTTCCGTCTAAAAAGTTCAAGGTTCTGGGAAATACAGACCGCCACA

GTATCAAAAAAATCTTATAGGGGCTCTTTTATTTGGCAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGCAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAATCTACAATCAATTATTTGAAGAAAACCCTATTAACGCAAGTAGAGTAGA

TGCTAAAGCGATTCTTTCTGCACGATTGAGTAAATCAAGACGATTAGAAAATCTCATTGCTC

AGCTCCCCGGTGAGAAGAGAAATGGCTTGTTTGGGAATCTCATTGCTTTGTCATTGGGATTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATAGT

GAAATAACTAAGGCTCCCCTATCAGCTTCAATGATTAAGCGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT
```

-continued

```
TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAGTACTACCAAAACATAGTTTGCTTTATGAGTA

TTTTACGGTTTATAACGAATTGACAAAGGTCAAATATGTTACTGAGGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGCGCCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGATATICAAAAAGCACAGGTGTCTGGACAAGGCCATAGTTTACATGAACAGA

TTGCTAACTTAGCTGGCAGTCCTGCTATTAAAAAAGGTATTTTACAGACTGTAAAAATTGTT

GATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAG

GTATCAAAGAATTAGGAAGTCAGATTCTTAAAGAGCATCCTGTTGAAAATACTCAATTGCAA

AATGAAAAGCTCTATCTCTATTATCTACAAAATGGAAGAGACATGTATGTGGACCAAGAATT

AGATATTAATCGTTTAAGTGATTATGATGTCGATCACATTGTTCCACAAAGTTTCATTAAAG

ACGATTCAATAGACAATAAGGTACTAACGCGTTCTGATAAAAATCGTGGTAAATCGGATAAC

GTTCCAAGTGAAGAAGTAGTCAAAAAGATGAAAAACTATTGGAGACAACTTCTAAACGCCAA

GTTAATCACTCAACGTAAGTTTGATAATTTAACGAAAGCTGAACGTGGAGGTTTGAGTGAAC

TTGATAAAGCTGGTTTTATCAAACGCCAATTGGTTGAAACTCGCCAAATCACTAAGCATGTG

GCACAAATTTTGGATAGTCGCATGAATACTAAATACGATGAAAATGATAAACTTATTCGAGA

GGTTAAAGTGATTACCTTAAAATCTAAATTAGTTTCTGACTTCCGAAAAGATTTCCAATTCT

ATAAAGTACGTGAGATTAACAATTACCATCATGCCCATGATGCGTATCTAAATGCCGTCGTT

GGAACTGCTTTGATTAAGAAATATCCAAAACTTGAATCGGAGTTTGTCTATGGTGATTATAA

AGTTTATGATGTTCGTAAAATGATTGCTAAGTCTGAGCAAGAAATAGGCAAAGCAACCGCAA

AATATTTCTTTTACTCTAATATCATGAACTTCTTCAAAACAGAAATTACACTTGCAAATGGA

GAGATTCGCAAACGCCCTCTAATCGAAACTAATGGGGAAACTGGAGAAATTGTCTGGGATAA

AGGGCGAGATTTTGCCACAGTGCGCAAAGTATTGTCCATGCCCCAAGTCAATATTGTCAAGA

AAACAGAAGTACAGACAGGCGGATTCTCCAAGGAGTCAATTTTACCAAAAAGAAATTCGGAC

AAGCTTATTGCTCGTAAAAAAGACTGGGATCCAAAAAAATATGGTGGTTTTGATAGTCCAAC

GGTAGCTTATTCAGTCCTAGTGGTTGCTAAGGTGGAAAAAGGGAAATCGAAGAAGTTAAAAT

CCGTTAAAGAGTTACTAGGGATCACAATTATGGAAAGAAGTTCCTTTGAAAAAAATCCGATT

GACTTTTTAGAAGCTAAAGGATATAAGGAAGTTAAAAAAGACTTAATCATTAAACTACCTAA

ATATAGTCTTTTTGAGTTAGAAAACGGTCGTAAACGGATGCTGGCTAGTGCCGGAGAATTAC
```

-continued

AAAAAGGAAATGAGCTGGCTCTGCCAAGCAAATATGTGAATTTTTTATATTTAGCTAGTCAT

TATGAAAAGTTGAAGGGTAGTCCAGAAGATAACGAACAAAAACAATTGTTTGTGGAGCAGCA

TAAGCATTATTTAGATGAGATTATTGAGCAAATCAGTGAATTTTCTAAGCGTGTTATTTTAG

CAGATGCCAATTTAGATAAAGTTCTTAGTGCATATAACAAACATAGAGACAAACCAATACGT

GAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATG

CCACTCTTATCCATCAATCCATCACTGGTCTTTATGAAACACGCATTGATTTGAGTCAGCTA

GGAGGTGACTGA (SEQ ID NO: 30)

MDKK<u>YSIGLDIGTNSVGWAVITDDYKVPSKKFKVLGNTDRHSIKKNLIGALLFGSGETAEAT</u>

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGAYHDLLKIIKDKDFLDNEENEDILEDIV

LTLTLFEDRGMIEERLKTYAHLFDDKVMKQLKRRRYTGWGRLSRKLINGIRDKQSGKTILDF

LKSDGFANRNFMQLIHDDSLTFKEDIQKAQVSGQG<u>HSLHEQIANLAGSPAIKKGILQTVKIV</u>

<u>DELVKVMGHKPENIVIEMAR</u>ENQTTQKG<u>QKNSRERMKRIEEGIKELGSQILKEHPVENTQLQ</u>

<u>NEKLYLYYLQNGRDMYVDQELDINRLSDYDVDHIVPQSFIKDDSIDNKVLTRSDKNRGKSDN</u>

<u>VPSEEVVKKMKNYWRQLLNAKLITQRKFDNLTKAERG</u>G<u>LSELDKAGFIKRQLVETRQITKHV</u>

<u>AQILDSRMNTKYDENDKLIREVKVITLKSKLVSDFRKDFQFYKVREINNYHHAHDAYLNAVV</u>

<u>GTALIKKYPKLESEFVYGDYKVYDVRKMIAKSEQEIGKATAKYFFYSNIMNFFKTEITLANG</u>

<u>EIRKRPLIETNGETGEIVWDKGRDFATVRKVLSMPQVN</u>IVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD (SEQ ID NO: 29)
(single underline: HNH domain; double underline: RuvC domain)

In some embodiments, wild-type Cas9 corresponds to, or comprises the following nucleotide and/or amino acid sequences:

ATGGATAAAAAGTATTCTATTGGTTTAGACATCGGCACTAATTCCGTTGGATGGGCTGTCAT

AACCGATGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

-continued

```
CCTTCCTTGTCGAAGAGGACAAGAAACATGAACGGCACCCCATCTTTGGAAACATAGTAGAT
GAGGTGGCATATCATGAAAAGTACCCAACGATTTATCACCTCAGAAAAAAGCTAGTTGACTC
AACTGATAAAGCGGACCTGAGGTTAATCTACTTGGCTCTTGCCCATATGATAAAGTTCCGTG
GGCACTTTCTCATTGAGGGTGATCTAAATCCGGACAACTCGGATGTCGACAAACTGTTCATC
CAGTTAGTACAAACCTATAATCAGTTGTTTGAAGAGAACCCTATAAATGCAAGTGGCGTGGA
TGCGAAGGCTATTCTTAGCGCCCGCCTCTCTAAATCCCGACGGCTAGAAAACCTGATCGCAC
AATTACCCGGAGAGAAGAAAAATGGGTTGTTCGGTAACCTTATAGCGCTCTCACTAGGCCTG
ACACCAAATTTTAAGTCGAACTTCGACTTAGCTGAAGATGCCAAATTGCAGCTTAGTAAGGA
CACGTACGATGACGATCTCGACAATCTACTGGCACAAATTGGAGATCAGTATGCGGACTTAT
TTTTGGCTGCCAAAAACCTTAGCGATGCAATCCTCCTATCTGACATACTGAGAGTTAATACT
GAGATTACCAAGGCGCCGTTATCCGCTTCAATGATCAAAAGGTACGATGAACATCACCAAGA
CTTGACACTTCTCAAGGCCCTAGTCCGTCAGCAACTGCCTGAGAAATATAAGGAAATATTCT
TTGATCAGTCGAAAAACGGGTACGCAGGTTATATTGACGGCGGAGCGAGTCAAGAGGAATTC
TACAAGTTTATCAAACCCATATTAGAGAAGATGGATGGGACGGAAGAGTTGCTTGTAAAACT
CAATCGCGAAGATCTACTGCGAAAGCAGCGGACTTTCGACAACGGTAGCATTCCACATCAAA
TCCACTTAGGCGAATTGCATGCTATACTTAGAAGGCAGGAGGATTTTTATCCGTTCCTCAAA
GACAATCGTGAAAAGATTGAGAAAATCCTAACCTTTCGCATACCTTACTATGTGGGACCCCT
GGCCCGAGGGAACTCTCGGTTCGCATGGATGACAAGAAAGTCCGAAGAAACGATTACTCCAT
GGAATTTTGAGGAAGTTGTCGATAAAGGTGCGTCAGCTCAATCGTTCATCGAGAGGATGACC
AACTTTGACAAGAATTTACCGAACGAAAAAGTATTGCCTAAGCACAGTTTACTTTACGAGTA
TTTCACAGTGTACAATGAACTCACGAAAGTTAAGTATGTCACTGAGGGCATGCGTAAACCCG
CCTTTCTAAGCGGAGAACAGAAGAAAGCAATAGTAGATCTGTTATTCAAGACCAACCGCAAA
GTGACAGTTAAGCAATTGAAAGAGGACTACTTTAAGAAAATTGAATGCTTCGATTCTGTCGA
GATCTCCGGGGTAGAAGATCGATTTAATGCGTCACTTGGTACGTATCATGACCTCCTAAAGA
TAATTAAAGATAAGGACTTCCTGGATAACGAAGAGAATGAAGATATCTTAGAAGATATAGTG
TTGACTCTTACCCTCTTTGAAGATCGGGAAATGATTGAGGAAAGACTAAAAACATACGCTCA
CCTGTTCGACGATAAGGTTATGAAACAGTTAAAGAGGCGTCGCTATACGGGCTGGGGACGAT
TGTCGCGGAAACTTATCAACGGGATAAGAGACAAGCAAAGTGGTAAAACTATTCTCGATTTT
CTAAAGAGCGACGGCTTCGCCAATAGGAACTTTATGCAGCTGATCCATGATGACTCTITAAC
CTTCAAAGAGGATATACAAAAGGCACAGGTTTCCGGACAAGGGGACTCATTGCACGAACATA
TTGCGAATCTTGCTGGTTCGCCAGCCATCAAAAAGGGCATACTCCAGACAGTCAAAGTAGTG
GATGAGCTAGTTAAGGTCATGGGACGTCACAAACCGGAAAACATTGTAATCGAGATGGCACG
CGAAAATCAAACGACTCAGAAGGGGCAAAAAAACAGTCGAGAGCGGATGAAGAGAATAGAAG
AGGGTATTAAAGAACTGGGCAGCCAGATCTTAAAGGAGCATCCTGTGGAAAATACCCAATTG
CAGAACGAGAAACTTTACCTCTATTACCTACAAAATGGAAGGGACATGTATGTTGATCAGGA
ACTGGACATAAACCGTTTATCTGATTACGACGTCGATCACATTGTACCCCAATCCTTTTTGA
AGGACGATTCAATCGACAATAAAGTGCTTACACGCTCGGATAAGAACCGAGGGAAAAGTGAC
AATGTTCCAAGCGAGGAAGTCGTAAAGAAAATGAAGAACTATTGGCGGCAGCTCCTAAATGC
GAAACTGATAACGCAAAGAAAGTTCGATAACTTAACTAAAGCTGAGAGGGGTGGCTTGTCTG
AACTTGACAAGGCCGGATTTATTAAACGTCAGCTCGTGGAAACCCGCCAAATCACAAAGCAT
GTTGCACAGATACTAGATTCCCGAATGAATACGAAATACGACGAGAACGATAAGCTGATTCG
```

-continued

```
GGAAGTCAAAGTAATCACTTTAAAGTCAAAATTGGTGTCGGACTTCAGAAAGGATTTTCAAT
TCTATAAAGTTAGGGAGATAAATAACTACCACCATGCGCACGACGCTTATCTTAATGCCGTC
GTAGGGACCGCACTCATTAAGAAATACCCGAAGCTAGAAAGTGAGTTTGTGTATGGTGATTA
CAAAGTTTATGACGTCCGTAAGATGATCGCGAAAAGCGAACAGGAGATAGGCAAGGCTACAG
CCAAATACTTCTTTTATTCTAACATTATGAATTTCTTTAAGACGGAAATCACTCTGGCAAAC
GGAGAGATACGCAAACGACCTTTAATTGAAACCAATGGGGAGACAGGTGAAATCGTATGGGA
TAAGGGCCGGGACTTCGCGACGGTGAGAAAAGTTTTGTCCATGCCCCAAGTCAACATAGTAA
AGAAAACTGAGGTGCAGACCGGAGGGTTTTCAAAGGAATCGATTCTTCCAAAAAGGAATAGT
GATAAGCTCATCGCTCGTAAAAAGGACTGGGACCCGAAAAAGTACGGTGGCTTCGATAGCCC
TACAGTTGCCTATTCTGTCCTAGTAGTGGCAAAAGTTGAGAAGGGAAAATCCAAGAAACTGA
AGTCAGTCAAAGAATTATTGGGGATAACGATTATGGAGCGCTCGTCTTTTGAAAAGAACCCC
ATCGACTTCCTTGAGGCGAAAGGTTACAAGGAAGTAAAAAAGGATCTCATAATTAAACTACC
AAAGTATAGTCTGTTTGAGTTAGAAAATGGCCGAAAACGGATGTTGGCTAGCGCCGGAGAGC
TTCAAAAGGGGAACGAACTCGCACTACCGICTAAATACGTGAATTTCCTGTATTTAGCGTCC
CATTACGAGAAGTTGAAAGGTTCACCTGAAGATAACGAACAGAAGCAACTTTTTGTTGAGCA
GCACAAACATTATCTCGACGAAATCATAGAGCAAATTTCGGAATTCAGTAAGAGAGTCATCC
TAGCTGATGCCAATCTGGACAAAGTATTAAGCGCATACAACAAGCACAGGGATAAACCCATA
CGTGAGCAGGCGGAAAATATTATCCATTTGTTTACTCTTACCAACCTCGGCGCTCCAGCCGC
ATTCAAGTATTTTGACACAACGATAGATCGCAAACGATACACTTCTACCAAGGAGGTGCTAG
ACGCGACACTGATTCACCAATCCATCACGGGATTATATGAAACTCGGATAGATTTGTCACAG
CTTGGGGGTGACGGATCCCCCAAGAAGAAGAGGAAAGTCTCGAGCGACTACAAAGACCATGA
CGGTGATTATAAAGATCATGACATCGATTACAAGGATGACGATGACAAGGCTGCAGGA
(SEQ ID NO: 31)
```

MDKK<u>YSIGLAIGTNSVGWAVITDEYKVPSKKFKVLGNTDRHSIKKNLIGALLFDSGETA</u>EAT
RLKRTARRRYTRRKNRICYLQEIFSNEMAKVDDSFFHRLEESFLVEEDKKHERHPIFGNIVD
EVAYHEKYPTIYHLRKKLVDSTDKADLRLIYLALAHMIKFRGHFLIEGDLNPDNSDVDKLFI
QLVQTYNQLFEENPINASGVDAKAILSARLSKSRRLENLIAQLPGEKKNGLFGNLIALSLGL
TPNFKSNFDLAEDAKLQLSKDTYDDDLDNLLAQIGDQYADLFLAAKNLSDAILLSDILRVNT
EITKAPLSASMIKRYDEHHQDLTLLKALVRQQLPEKYKEIFFDQSKNGYAGYIDGGASQEEF
YKFIKPILEKMDGTEELLVKLNREDLLRKQRTFDNGSIPHQIHLGELHAILRRQEDFYPFLK
DNREKIEKILTFRIPYYVGPLARGNSRFAWMTRKSEETITPWNFEEVVDKGASAQSFIERMT
NFDKNLPNEKVLPKHSLLYEYFTVYNELTKVKYVTEGMRKPAFLSGEQKKAIVDLLFKTNRK
VTVKQLKEDYFKKIECFDSVEISGVEDRFNASLGTYHDLLKIIKDKDFLDNEENEDILEDIV
LTLTLFEDREMIEERLKTYAHLFDDKVMKQLKRRRYTGWGRLSRKLINGIRDKQSGKTILDF
LKSDGFANRNFMQLIHDDSLTFKEDIQKAQVSGQG<u>DSLHEHIANLAGSPAIKKGILQTVKVV
DELVKVMGRHKPENIVIEMAR</u>ENQTTQKGQKNSRERMKRIEEGIKELGSQILKEHPVENTQL
QNEKLYLYYLQNGRDMYVDQELDINRLSDYDVDHIVPQSFLKDDSIDNKVLTRSDKNRGKSD
NVPSEEVVKKMKNYWRQLLNAKLITQRKFDNLTKAERG<u>GLSELDKAGFIKRQLVETRQITKH
VAQILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQT</u>GGFSKESILPKRNS

-continued

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 32)
(single underline: HNH domain; double underline: RuvC domain).

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows):

ATGGATAAGAAATACTCAATAGGCTTAGATATCGGCACAAATAGCGTCGGATGGGCGGTGAT

CACTGATGAATATAAGGTTCCGTCTAAAAAGTTCAAGGTTCTGGGAAATACAGACCGCCACA

GTATCAAAAAAATCTTATAGGGGCTCTTTTATTTGACAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGTAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAACCTACAATCAATTATTTGAAGAAAACCCTATTAACGCAAGTGGAGTAGA

TGCTAAAGCGATTCTTTCTGCACGATTGAGTAAATCAAGACGATTAGAAAATCTCATTGCTC

AGCTCCCCGGTGAGAAGAAAAATGGCTTATTTGGGAATCTCATTGCTTTGTCATTGGGTTTG

ACCCCTAATTTTAAATCAAATTTTGATTTGGCAGAAGATGCTAAATTACAGCTTTCAAAGA

TACTTACGATGATGATTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAAATGAAGATATCTTAGAGGATATTGTT

-continued

```
TTAACATTGACCTTATTTGAAGATAGGGAGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA

AGAAAACAGAAGTACAGACAGGCGGATTCTCCAAGGAGTCAATTTTACCAAAAAGAAATTCG

GACAAGCTTATTGCTCGTAAAAAAGACTGGGATCCAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAAGAAGTTCCTTTGAAAAAAATCCG

ATTGACTTTTTAGAAGCTAAAGGATATAAGGAAGTTAAAAAAGACTTAATCATTAAACTACC

TAAATATAGTCTTTTTGAGTTAGAAAACGGTCGTAAACGGATGCTGGCTAGTGCCGGAGAAT

TACAAAAAGGAAATGAGCTGGCTCTGCCAAGCAAATATGTGAATTTTTTATATTTAGCTAGT

CATTATGAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA (SEQ ID NO: 33)
```

MDKK<u>YSIGLDIGTNSVGWAVITDEYKVPSKKFKVLGNTDRHSIKKNLIGALLFDSGETA</u>EAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

-continued

```
TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 1)
(single underline: HNH domain; double underline: RuvC domain)
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

The amino acid sequence of an exemplary catalytically inactive Cas9 (dCas9) is as follows:

```
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF
```

```
                        -continued
YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 36)
(see, e.g., Qi et al., "Repurposing CRISPR as an RNA-guided
platform for sequence-specific control of gene expression."
Cell. 2013; 152(5): 1173-83, the entire contents of which
are incorporated herein by reference).
```

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

In some embodiments, a Cas9 nuclease has an inactive (e.g., an inactivated) DNA cleavage domain, that is, the Cas9 is a nickase, referred to as an "nCas9" protein (for "nickase" Cas9). A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)).

In some embodiments, the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9.

In some embodiments, the dCas9 comprises the amino acid sequence of dCas9 (D10A and H840A):

```
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 36)
(single underline: HNH domain; double underline: RuvC domain).
```

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field and are within the scope of this disclosure. The amino acid sequence of an exemplary catalytically Cas9 nickase (nCas9) is as follows:

```
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 78)
```

In some embodiments, Cas9 refers to a Cas9 from archaea (e.g., nanoarchaea), which constitute a domain and kingdom of single-celled prokaryotic microbes. In some embodiments, the programmable nucleotide binding protein may be a CasX or CasY protein, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, in a base editor system described herein Cas9 is replaced by CasX, or a variant of CasX. In some embodiments, in a base editor system described herein Cas9 is replaced by CasY, or a variant of CasY. It should be appreciated that other RNA-guided DNA binding proteins may be used as a nucleic acid programmable DNA binding protein (napDNAbp) and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the programmable nucleotide binding protein is a naturally-occurring CasX or CasY protein. In some embodiments, the programmable nucleotide binding protein comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

An exemplary CasX ((uniprot.org/uniprot/F0NN87; uniprot.org/uniprot/F0NH53) tr|F0NN87|F0NN87_SULIHCRISPR-associatedCasx protein OS=Sulfolobus islandicus (strain HVE10/4) GN=SiH_0402 PE=4 SV=1) amino acid sequence is as follows:

```
MEVPLYNIFGDNYIIQVATEAENSTIYNNKVEIDDEELRNVLNLAYKIA

KNNEDAAAERRGKAKKKKGEEGETTTSNIILPLSGNDKNPWTETLKCYN
```

```
FPTTVALSEVFKNFSQVKECEEVSAPSFVKPEFYEFGRSPGMVERTRRV

KLEVEPHYLIIAAAGWVLTRLGKAKVSEGDYVGVNVFTPTRGILYSLIQ

NVNGIVPGIKPETAFGLWIARKVVSSVTNPNVSVVRIYTISDAVGQNPT

TINGGFSIDLTKLLEKRYLLSERLEAIARNALSISSNMRERYIVLANYI

YEYLTG SKRLEDLLYFANRDLIMNLNSDDGKVRDLKLISAYVNGELIR

GEG (SEQ ID NO: 41).
```

An exemplary CasX (>tr|F0NH53|F0NH53_SULIR CRISPR associated protein, Casx OS=*Sulfolobus islandicus* (strain REY15A) GN=SiRe_0771 PE=4 SV=1) amino acid sequence is as follows:

```
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYKFGRSPGMVERTRRVKLE

VEPHYLIMAAAGWVLTRLGKAKVSEGDYVGVNVFTPTRGILYSLIQNVNG

IVPGIKPETAFGLWIARKVVSSVTNPNVSVVSIYTISDAVGQNPTTINGG

FSIDLTKLLEKRDLLSERLEAIARNALSISSNMRERYIVLANYIYEYLTG

SKRLEDLLYFANRDLIMNLNSDDGKVRDLKLISAYVNGELIRGEG
(SEQ ID NO: 42).

Deltaproteobacteria CasX
MEKRINKIRKKLSADNATKPVSRSGPMKTLLVRVMTDDLKKRLEKRRKKP

EVMPQVISNNAANNLRMLLDDYTKMKEAILQVYWQEFKDDHVGLMCKFAQ

PASKKIDQNKLKPEMDEKGNLTTAGFACSQCGQPLFVYKLEQVSEKGKAY

TNYFGRCNVAEHEKLILLAQLKPVKDSDEAVTYSLGKFGQRALDFYSIHV

TKESTHPVKPLAQIAGNRYASGPVGKALSDACMGTIASFLSKYQDIIIEH

QKVVKGNQKRLESLRELAGKENLEYPSVTLPPQPHTKEGVDfAYNEVIAR

VRMWVNLNLWQKLKLSRDDAKPLLRLKGFPSFPVVERRENEVDWWNTINE

VKKLIDAKRDMGRVFWSGVTAEKRNTILEGYNYLPNENDHKKREGSLENP

KKPAKRQFGDLLLYLEKKYAGDWGKVFDEAWERIDKKIAGLTSHIEREEA

RNAEDAQSKAVLTDWLRAKASFVLERLKEMDEKEFYACEIQLQKWYGDLR

GNPFAVEAENRVVDISGFSIGSDGHSIQYRNLLAWKYLENGKREFYLLMN

YGKKGRIRFTDGTDIKKSGKWQGLLYGGGKAKVIDLTFDPDDEQLIILPL

AFGTRQGREFIWNDLLSLETGLIKLANGRVIEKTIYNKKIGRDEPALFVA

LTFERREVVDPSNIKPVNLIGVARGENIPAVIALTDPEGCPLPEFKDSSG

GPTDILRIGEGYKEKQRAIQAAKEVEQRRAGGYSRKFASKSRNLADDMVR

NSARDLFYHAVTHDAVLVFANLSRGFGRQGKRTFMTERQYTKMEDWLTAK

LAYEGLTSKTYLSKTLAQYTSKTCSNCGFTITYADMDVMLVRLKKTSDGW

ATTLNNKELKAEYQITYYNRYKRQTVEKELSAELDRLSEESGNNDISKWT

KGRRDEALFLLKKRFSHRPVQEQFVCLDCGHEVHAAEQAALNIARSWLFL

NSNSTEFKSYKSGKQPFVGAWQAFYKRRLKEVWKPNA
(SEQ ID NO: 79)
```

An exemplary CasY ((ncbi.nlm.nih.gov/protein/APG80656.1)>APG80656.1 CRISPR-associated protein CasY [uncultured Parcubacteria group bacterium]) amino acid sequence is as follows:

```
MSKRHPRISGVKGYRLHAQRLEYTGKSGAMRTIKYPLYSSPSGGRTVPRE

IVSAINDDYVGLYGLSNFDDLYNAEKRNEEKVYSVLDFWYDCVQYGAVFS

YTAPGLLKNVAEVRGGSYELTKTLKGSHLYDELQIDKVIKFLNKKEISRA

NGSLDKLKKDIIDCFKAEYRERHKDQCNKLADDIKNAKKDAGASLGERQK

KLFRDFFGISEQSENDKPSFTNPLNLTCCLLPFDTVNNNRNRGEVLFNKL

KEYAQKLDKNEGSLEMWEYIGIGNSGTAFSNFLGEGFLGRLRENKITELK

KAMMDITDAWRGQEQEEELEKRLRILAALTIKLREPKFDNHWGGYRSDIN

GKLSSWLQNYINQTVKIKEDLKGHKKDLKKAKEMINRFGESDTKEEAVVS

SLLESIEKIVPDDSADDEKPDIPAIAIYRRFLSDGRLTLNRFVQREDVQE

ALIKERLEAEKKKKPKKRKKKSDAEDEKETIDFKELFPHLAKPLKLVPNF

YGDSKRELYKKYKNAAIYTDALWKAVEKIYKSAFSSSLKNSFFDTDFDKD

FFIKRLQKIFSVYRRFNTDKWKPIVKNSFAPYCDIVSLAENEVLYKPKQS

RSRKSAAIDKNRVRLPSTENIAKAGIALARELSVAGFDWKDLLKKEEHEE

YIDLIELHKTALALLLAVTETQLDISALDFVENGTVKDFMKTRDGNLVLE

GRFLEMFSQSIVFSELRGLAGLMSRKEFITRSAIQTMNGKQAELLYIPHE

FQSAKITTPKEMSRAFLDLAPAEFATSLEPESLSEKSLLKLKQMRYYPHY

FGYELTRTGQGIDGGVAENALRLEKSPVKKREIKCKQYKTLGRGQNKIVL

YVRSSYYQTQFLEWFLHRPKNVQTDVAVSGSFLIDEKKVKTRWNYDALTV

ALEPVSGSERVFVSQPFTIFPEKSAEEEGQRYLGIDIGEYGIAYTALEIT

GDSAKILDQNFISDPQLKTLREEVKGLKLDQRRGTFAMPSTKIARIRESL

VHSLRNRIHHLALKHKAKIVYELEVSRFEEGKQKIKKVYATLKKADVYSE

IDADKNLQTTVWGKLAVASEISASYTSQFCGACKKLWRAEMQVDETITTQ

ELIGTVRVIKGGTLIDAIKDFMRPPIFDENDTPFPKYRDFCDKHHISKKM

RGNSCLFICPFCRANADADIQASQTIALLRYVKEEKKVEDYFERFRKLKN

IKVLGQMKKI (SEQ ID NO: 44).
```

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some embodiments, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)] (e.g., (b+c)/(a+b+c), where "a" is the band intensity of DNA substrate and "b" and "c" are the cleavage products).

In some embodiments, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2}) \times 100$, where "a" is the band intensity of DNA substrate and "b" and "c" are the cleavage products (Ran et. al., Cell. 2013 Sep. 12; 154(6):1380-9; and Ran et al., Nat Protoc. 2013 November; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most embodiments, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag. In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some embodiments, Cas9 is a variant Cas9 protein. A variant Cas9 polypeptide has an amino acid sequence that is different by one amino acid (e.g., has a deletion, insertion, substitution, fusion) when compared to the amino acid sequence of a wild-type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some embodiments, the variant Cas9 protein has no substantial nuclease activity. When a subject Cas9 protein is a variant Cas9 protein that has no substantial nuclease activity, it can be referred to as "dCas9."

In some embodiments, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some embodiments, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some embodiments, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some embodiments, a variant Cas9 protein has a reduced ability to cleave both the complementary and the non-complementary strands of a double stranded target DNA. As a non-limiting example, in some embodiments, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some embodiments, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such embodiments, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' was used.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 doesn't need the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

In some embodiments, the Cas9 is a Cas9 variant having specificity for an altered PAM sequence. In some embodiments, the Additional Cas9 variants and PAM sequences are described in Miller, S. M., et al. Continuous evolution of SpCas9 variants compatible with non-G PAMs, Nat. Biotechnol. (2020), the entirety of which is incorporated herein by reference. in some embodiments, a Cas9 variate have no specific PAM requirements. In some embodiments, a Cas9 variant, e.g. a SpCas9 variant has specificity for a NRNH PAM, wherein R is A or G and H is A, C, or T. In some embodiments, the SpCas9 variant has specificity for a PAM sequence AAA, TAA, CAA, GAA, TAT, GAT, or CAC. In some embodiments, the SpCas9 variant comprises an amino acid substitution at position 1114, 1134, 1135, 1137, 1139, 1151, 1180, 1188, 1211, 1218, 1219, 1221, 1249, 1256, 1264, 1290, 1318, 1317, 1320, 1321, 1323, 1332, 1333, 1335, 1337, or 1339 as numbered in SEQ ID NO: 1 or a corresponding position thereof. In some embodiments, the SpCas9 variant comprises an amino acid substitution at position 1114, 1135, 1218, 1219, 1221, 1249, 1320, 1321, 1323, 1332, 1333, 1335, or 1337 as numbered in SEQ ID NO: 1 or a corresponding position thereof. In some embodiments, the SpCas9 variant comprises an amino acid substitution at position 1114, 1134, 1135, 1137, 1139, 1151, 1180, 1188, 1211, 1219, 1221, 1256, 1264, 1290, 1318, 1317, 1320, 1323, 1333 as numbered in SEQ ID NO: 1 or a corresponding position thereof. In some embodiments, the SpCas9 variant comprises an amino acid substitution at position 1114, 1131, 1135, 1150, 1156, 1180, 1191, 1218, 1219, 1221, 1227, 1249, 1253, 1286, 1293, 1320, 1321, 1332, 1335, 1339 as numbered in SEQ ID NO: 1 or a corresponding position thereof. In some embodiments, the SpCas9 variant comprises an amino acid substitution at position 1114, 1127, 1135, 1180, 1207, 1219, 1234, 1286, 1301, 1332, 1335, 1337, 1338, 1349 as numbered in SEQ ID NO: 1 or a corresponding position thereof. Exemplary amino acid substitutions and PAM specificity of SpCas9 variants are shown in Tables 1A-1D.

TABLE 1A

| | | SpCas9 amino acid position | | | | | | | | | | | |
|---|---|---|---|---|---|---|---|---|---|---|---|---|---|
| SpCas9 | 1114 R | 1135 D | 1218 G | 1219 E | 1221 Q | 1249 P | 1320 A | 1321 P | 1323 A | 1332 D | 1333 R | 1335 R | 1337 T |
| AAA | | N | | V | H | | | | | | G | | |
| AAA | | N | | V | H | | | | | | G | | |
| AAA | | | | V | | | | | | | G | | |
| TAA | G | N | | V | | | | | | | I | | |
| TAA | | N | | V | | | | | | | I | | A |
| TAA | G | N | | V | | | | | | | I | | A |
| CAA | | | | V | | | | | | | K | | |
| CAA | | N | | V | | | | | | | K | | |
| CAA | | N | | V | | | | | | | K | | |
| GAA | | | | V | H | | V | | | | K | | |
| GAA | | N | | V | | | V | | | | K | | |
| GAA | | | | V | H | | V | | | | K | | |
| TAT | | | S | V | H | S | | S | | | | L | |
| TAT | | | S | V | H | S | | S | | | | L | |
| TAT | | | S | V | H | S | | S | | | | L | |
| GAT | | | | V | | | | | | | I | | |
| GAT | | | | V | | | | | | D | | Q | |
| GAT | | | | V | | | | | | D | | Q | |
| CAC | | | | V | | | | | | | N | Q | N |
| CAC | | N | | V | | | | | | | | Q | N |
| CAC | | | | V | | | | | | | N | Q | N |

TABLE 1B

| | | | SpCas9 amino acid position | | | | | | | | | | | | | | | |
|---|---|---|---|---|---|---|---|---|---|---|---|---|---|---|---|---|---|---|
| SpCas9 | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
| GAA | | | | | | | | | | V | H | | | | | | V | | K |
| GAA | | | N | S | | | | | | V | | | | | | | V | D | K |
| GAA | | | N | | | | | | | V | H | | Y | | | | V | | K |
| CAA | | | N | | | | | | | V | H | | Y | | | | V | | K |
| CAA | G | | N | S | | | | | | V | H | | Y | | | | V | | K |
| CAA | | | N | | | | | R | | V | H | | | | | | V | | K |
| CAA | | | N | | | | G | | R | V | H | | Y | | | | V | | K |
| CAA | | | N | | | | | | | V | H | | Y | | | | V | | K |
| AAA | | | N | | | | G | | | V | H | R | Y | | | | V | D | K |
| CAA | G | | N | | | | G | | | V | H | | Y | | | | V | D | K |
| CAA | | L | N | | | | G | | | V | H | | Y | | | T | V | D | K |
| TAA | G | | N | | | | G | | | V | H | | Y | G | S | | V | D | K |
| TAA | G | | N | | E | | G | | | V | H | | Y | | S | | V | | K |
| TAA | G | | N | | | | G | | | V | H | | Y | | S | | V | D | K |
| TAA | G | | N | | | | G | R | | V | H | | | | | | V | | K |
| TAA | | | N | | | | G | R | | V | H | | Y | | | | V | | K |
| TAA | G | | N | | A | | G | | | V | H | | | | | | V | | K |
| TAA | G | | N | | | | | | | V | H | | | | | | V | | K |

TABLE 1C

| | SpCas9 amino acid position | | | | | | | | | | |
|---|---|---|---|---|---|---|---|---|---|---|---|
| SpCas9 | 1114 R | 1131 Y | 1135 D | 1150 E | 1156 K | 1180 D | 1191 K | 1218 G | 1219 E | 1221 Q | 1227 A |
| SacB.TAT | | | N | | | | N | | V | H | |
| SacB.TAT | | | N | | | | | S | V | H | |
| AAT | | | N | | | | | S | V | H | V |
| TAT | G | | N | | | G | | S | V | H | |
| TAT | G | | N | | | G | | S | V | H | |
| TAT | G | C | N | | | G | | S | V | H | |
| TAT | G | C | N | | | G | | S | V | H | |
| TAT | G | C | N | | | G | | S | V | H | |
| TAT | G | C | N | | E | G | | S | V | H | |
| TAT | G | C | N | V | | G | | S | V | H | |
| TAT | | C | N | | | G | | S | V | H | |
| TAT | G | C | N | | | G | | S | V | H | |

| | SpCas9 amino acid position | | | | | | | | |
|---|---|---|---|---|---|---|---|---|---|
| SpCas9 | 1249 P | 1253 E | 1286 N | 1293 A | 1320 A | 1321 P | 1332 D | 1335 R | 1339 T |
| SacB.TAT | | | | | V | S | | L | |
| SacB.TAT | S | | | | | S | G | L | |
| AAT | S | | K | T | | S | G | L | I |
| TAT | S | K | | | | S | G | L | |
| TAT | S | | | | | S | G | L | |
| TAT | S | | | | | S | G | L | |
| TAT | S | | | | | S | G | L | |
| TAT | S | | | | | S | G | L | |
| TAT | S | | | | | S | G | L | |
| TAT | S | | | | | S | G | L | |
| TAT | S | | | | | S | G | L | |
| TAT | S | | | | | S | G | L | |

TABLE 1D

| | SpCas9 amino acid position | | | | | | | | | | | | | |
|---|---|---|---|---|---|---|---|---|---|---|---|---|---|---|
| SpCas9 | 1114 R | 1127 D | 1135 D | 1180 D | 1207 E | 1219 E | 1234 N | 1286 N | 1301 P | 1332 D | 1335 R | 1337 T | 1338 S | 1349 H |
| SacB.CAC | | | N | | | V | | | | N | Q | N | | |
| AAC | G | | N | | | V | | | | N | Q | N | | |
| AAC | G | | N | | | V | | | | N | Q | N | | |
| TAC | G | | N | | | V | | | | N | Q | N | | |
| TAC | G | | N | | | V | | H | | N | Q | N | | |
| TAC | G | | N | | G | V | D | H | | N | Q | N | | |
| TAC | G | | N | | | V | | | | N | Q | N | | |
| TAC | G | G | N | E | | V | | H | | N | Q | N | | |
| TAC | G | | N | | | V | | H | | N | Q | N | | |
| TAC | G | | N | | | V | | | | N | Q | N | T | R |

In some embodiments, the Cas9 is a *Neisseria menigitidis* Cas9 (NmeCas9) or a variant thereof. In some embodiments, the NmeCas9 has specificity for a NNNNGAYW PAM, wherein Y is C or T and W is A or T. In some embodiments, the NmeCas9 has specificity for a NNNNGYTT PAM, wherein Y is C or T. In some embodiments, the NmeCas9 has specificity for a NNNNGTCT PAM. In some embodiments, the NmeCas9 is a Nme1 Cas9. In some embodiments, the NmeCas9 has specificity for a NNNNGATT PAM, a NNNNCCTA PAM, aNNNNCCTC PAM, a NNNNCCTT PAM, a NNNNCCTG PAM, a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the Nme1Cas9 has specificity for a NNNNGATT PAM, a NNNNCCTA PAM, a NNNNCCTC PAM, a NNNNCCTT PAM, or a NNNNCCTG PAM. In some embodiments, the NmeCas9 has specificity for a CAA PAM, a CAAA PAM, or a CCA PAM. In some embodiments, the NmeCas9 is a Nme2 Cas9. In some embodiments, the NmeCas9 has specificity for a NNNNCC (N4CC) PAM, wherein N is any one of A, G, C, or T. in some embodiments, the NmeCas9 has specificity for a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the NmeCas9 is a Nme3Cas9. In some embodiments, the NmeCas9 has specificity for a NNNNCAAA PAM, a NNNNCC PAM, or a NNNNCNNN PAM. Additional NmeCas9 features and PAM sequences as described in Edraki et al. Mol. Cell. (2019) 73(4): 714-726 is incorporated herein by reference in its entirety.

An exemplary amino acid sequence of a Nme1Cas9 is provided below:

```
type II CRISPR RNA-guided endonuclease Cas9
[Neisseria meningitidis] WP_002235162.1
   1 maafkpnpin yilgldigia svgwamveid edenpiclid
     lgvrvferae vpktgdslam 61 arrlarsvrr ltrrrahrll rarrllkreg vlqaadfden
     glikslpntp wqlraaaldr 121 kltplewsav llhlikhrgy lsqrkneget adkelgallk
     gvadnahalq tgdfrtpael 181 alnkfekesg hirnqrgdys htfsrkdlqa elillfekqk
     efgnphvsgg lkegietllm 241 tqrpalsgda vqkmlghctf epaepkaakn tytaerfiwl
     tklnnlrile qgserpltdt 301 eratlmdepy rkskltyaqa rkllgledta ffkglrygkd
     naeastlmem kayhaisral 361 ekeglkdkks pinlspelqd eigtafslfk tdeditgrlk
     driqpeilea llkhisfdkf 421 vqislkalrr ivplmeqgkr ydeacaeiyg dhygkkntee
     kiylppipad eirnpvvlra 481 lsgarkving vvrrygspar ihietarevg ksfkdrkeie
     krqeenrkdr ekaaakfrey 541 fpnfvgepks kdilklrlye qqhgkclysg keinlgrine
     kgyveidhal pfsrtwddsf 601 nnkvlvlgse nqnkgnqtpy eyfngkdnsr ewqefkarve
     tsrfprskkq rillqkfded 661 gfkernlndt ryvnrflcqf vadrmrltgk gkkrvfasng
     qitnllrgfw glrkvraend 721 rhhaldavvv acstvamqqk itrfvrykem nafdgktidk
     etgevlhqkt hfpqpweffa 781 qevmirvfgk pdgkpefeea dtpeklrtll aeklssrpea
     vheyvtplfv srapnrkmsg 841 qghmetvksa krldegvsvl rvpltqlklk dlekmvnrer
     epklyealka rleahkddpa 901 kafaepfyky dkagnrtqqv kavrveqvqk tgvwvrnhng
     iadnatmvrv dvfekgdkyy 961 lvpiyswqva kgilpdravv qgkdeedwql iddsfnfkfs
     lhpndlvevi tkkarmfgyf 1021 aschrgtgni nirihdldhk igkngilegi gvktalsfqk
     yqidelgkei rperlkkrpp 1081 vr (SEQ ID NO: 34)
```

An exemplary amino acid sequence of a Nme2Cas9 is provided below:

```
type II CRISPR RNA-guided endonuclease Cas9
[Neisseria meningitidis] WP_002230835.1
   1 maafkpnpin yilgldigia svgwamveid eeenpirlid
     lgvrvferae vpktgdslam 61 arrlarsvrr ltrrrahrll rarrllkreg vlqaadfden
     glikslpntp wqlraaaldr 121 kltplewsav llhlikhrgy lsqrkneget adkelgallk
     gvannahalq tgdfrtpael 181 alnkfekesg hirnqrgdys htfsrkdlqa elillfekqk
     efgnphvsgg lkegietlllm 241 tqrpalsgda vqkmlghctf epaepkaakn tytaerfiwl
     tklnnlrile qgserpltdt 301 eratlmdepy rkskltyaqa rkllgledta ffkglrygkd
     naeastlmem kayhaisral 361 ekeglkdkks pinlsselqd eigtafslfk tdeditgrlk
     drvqpeilea llkhisfdkf 421 vqislkalrr ivplmeqgkr ydeacaeiyg dhygkkntee
     kiylppipad eirnpvvlra 481 lsgarkving vvrrygspar ihietarevg ksfkdrkeie
     krqeenrkdr ekaaakfrey 541 fpnfvgepks kdilklrlye qqhgkclysg keinlvrine
     kgyveidhal pfsrtwddsf 601 nnkvlvlgse nqnkgnqtpy eyfngkdnsr ewqefkarve
     tsrfprskkq rillqkfded 661 gfkecnlndt ryvnrflcqf vadhilltgk gkrrvfasng
     qitnllrgfw glrkvraend 721 rhhaldavvv acstvamqqk itrfvrykem nafdgktidk
     etgkvlhqkt hfpqpweffa 781 qevmirvfgk pdgkpefeea dtpeklrtll aeklssrpea
     vheyvtplfv srapnrkmsg 841 ahkdtlrsak rfvkhnekis vkrvwlteik ladlenmvny
     kngreielye alkarleayg 901 gnakqafdpk dnpfykkggq lvkavrvekt qesgvllnkk
     naytiadngd mvrvdvfckv 961 dkkgknqyfi vpiyawqvae nilpdidckg yriddsytfc
     fslhkydlia fqkdekskve 1021 fayyincdss ngrfylawhd kgskeqqfri stqnlvliqk
     yqvnelgkei rpcrlkkrpp 1081 vr (SEQ ID NO: 35)
```

Cas12 Domains of Nucleobase Editors

Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors, albeit different types (Type II and Type V, respectively). In addition to Cpf1, Class 2, Type V CRISPR-Cas systems also comprise Cas12a/Cpf1, Cas12b/C2c1, Cas12c/C2c3, Cas12d/CasY, Cas12e/CasX, Cas12g, Cas12h, and Cas12i). See, e.g., Shmakov et al., "Discovery and Functional Characterization of Diverse Class 2 CRISPR Cas Systems," Mol. Cell, 2015 Nov. 5; 60(3): 385-397; Makarova et al., "Classification and Nomenclature of CRISPR-Cas Systems: Where from Here?" CRISPR Journal, 2018, 1(5): 325-336; and Yan et al., "Functionally Diverse Type V CRISPR-Cas Systems," Science, 2019 Jan. 4; 363: 88-91; the entire contents of each is hereby incorporated by reference. Type V Cas proteins contain a RuvC (or RuvC-like) endonuclease domain. While production of mature CRISPR RNA (crRNA) is generally tracrRNA-independent, Cas12b/C2c1, for example, requires tracrRNA for production of crRNA. Cas12b/C2c1 depends on both crRNA and tracrRNA for DNA cleavage.

Nucleic acid programmable DNA binding proteins contemplated in the present disclosure include Cas proteins that are classified as Class 2, Type V (Cas12 proteins). Non-limiting examples of Cas Class 2, Type V proteins include Cas12a/Cpf1, Cas12b/C2c1, Cas12c/C2c3, Cas12d/CasY, Cas12e/CasX, Cas12g, Cas12h, and Cas12i, homologues thereof, or modified versions thereof. As used herein, a Cas12 protein can also be referred to as a Cas12 nuclease, a Cas12 domain, or a Cas12 protein domain. In some embodiments, the Cas12 proteins of the present disclosure comprise an amino acid sequence interrupted by an internally fused protein domain such as a deaminase domain.

In some embodiments, the Cas12 domain is a nuclease inactive Cas12 domain or a Cas12 nickase. In some embodiments, the Cas12 domain is a nuclease active domain. For example, the Cas12 domain may be a Cas12 domain that nicks one strand of a duplexed nucleic acid (e.g., duplexed DNA molecule). In some embodiments, the Cas12 domain comprises any one of the amino acid sequences as set forth herein. In some embodiments the Cas12 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas12 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas12 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas12 are provided. For example, in some embodiments, a protein comprises one of two Cas12 domains: (1) the gRNA binding domain of Cas12; or (2) the DNA cleavage domain of Cas12. In some embodiments, proteins comprising Cas12 or fragments thereof are referred to as "Cas12 variants." A Cas12 variant shares homology to Cas12, or a fragment thereof. For example, a Cas12 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas12. In some embodiments, the Cas12 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas12. In some embodiments, the Cas12 variant comprises a fragment of Cas12 (e.g., a gRNA binding domain or a DNA cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas12. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas12. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas12 corresponds to, or comprises in part or in whole, a Cas12 amino acid sequence having one or more mutations that alter the Cas12 nuclease activity. Such mutations, by way of example, include amino acid substitutions within the RuvC nuclease domain of Cas12. In some embodiments, variants or homologues of Cas12 are provided which are at least about 70% identical, at least about 80% identical, at least about 90% identical, at least about 95% identical, at least about 98% identical, at least about 99% identical, at least about 99.5% identical, or at least about 99.9% identical to a wild type Cas12. In some embodiments, variants of Cas12 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas12 fusion proteins as provided herein comprise the full-length amino acid sequence of a Cas12 protein, e.g., one of the Cas12 sequences provided herein. In other embodiments, however, fusion proteins as provided herein do not comprise a full-length Cas12 sequence, but only one or more fragments thereof. Exemplary amino acid sequences of suitable Cas12 domains are provided herein, and additional suitable sequences of Cas12 domains and fragments will be apparent to those of skill in the art.

Generally, the class 2, Type V Cas proteins have a single functional RuvC endonuclease domain (See, e.g., Chen et al., "CRISPR-Cas12a target binding unleashes indiscriminate single-stranded DNase activity," Science 360:436-439 (2018)). In some cases, the Cas12 protein is a variant Cas12b protein. (See Strecker et al., Nature Communications, 2019, 10(1): Art. No.: 212). In one embodiment, a variant Cas12 polypeptide has an amino acid sequence that is different by 1, 2, 3, 4, 5 or more amino acids (e.g., has a deletion, insertion, substitution, fusion) when compared to the amino acid sequence of a wild type Cas12 protein. In some instances, the variant Cas12 polypeptide has an amino acid change (e.g., deletion, insertion, or substitution) that reduces the activity of the Cas12 polypeptide. For example, in some instances, the variant Cas12 is a Cas12b polypeptide that has less than 50%, less than 40%, less than 30%, less than 20%, less than 10%, less than 5%, or less than 1% of the nickase activity of the corresponding wild-type Cas12b protein. In some cases, the variant Cas12b protein has no substantial nickase activity.

In some cases, a variant Cas12b protein has reduced nickase activity. For example, a variant Cas12b protein exhibits less than about 20%, less than about 15%, less than about 10%, less than about 5%, less than about 1%, or less than about 0.1%, of the nickase activity of a wild-type Cas12b protein.

In some embodiments, the Cas12 protein includes RNA-guided endonucleases from the Cas12a/Cpf1 family that displays activity in mammalian cells. CRISPR from *Prevotella* and *Francisella* 1 (CRISPR/Cpf1) is a DNA editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1, unlike Cas9, does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2, and Cas4 proteins are more similar to types I and III than type II systems. Functional Cpf1 does not require the trans-activating CRISPR RNA (tracrRNA), therefore, only CRISPR (crRNA) is required. This benefits genome editing because Cpf1 is not only smaller than Cas9, but also it has a smaller sgRNA molecule (approximately half as many nucleotides as Cas9). The Cpf1-crRNA complex cleaves target DNA or RNA by identification of a protospacer adjacent motif 5'-YTN-3' or 5'-TTTN-3' in contrast to the G-rich PAM targeted by Cas9. After identification of PAM, Cpf1 introduces a sticky-end-like DNA double-stranded break having an overhang of 4 or 5 nucleotides.

In some aspects of the present disclosure, a vector encodes a CRISPR enzyme that is mutated to with respect to a corresponding wild-type enzyme such that the mutated CRISPR enzyme lacks the ability to cleave one or both strands of a target polynucleotide containing a target sequence can be used. Cas12 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., Cas12 from *Bacillus hisashii*). Cas12 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., from *Bacillus hisashii* (BhCas12b), *Bacillus* sp. V3-13 (BvCas12b), and *Alicyclobacillus acidiphilus* (AaCas12b)). Cas12 can refer to the wild type or a modified form of the Cas12 protein that can comprise an amino acid change such as a deletion, insertion, substitution, variant, mutation, fusion, chimera, or any combination thereof.

Nucleic Acid Programmable DNA Binding Proteins

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. In particular embodiments, a fusion protein comprises a nucleic acid programmable DNA binding protein domain and a deaminase domain. Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" CRISPR J. 2018 October; 1:325-336. doi: 10.1089/crispr.2018.0033; Yan et al., "Functionally diverse type V CRISPR-Cas systems" Science. 2019 Jan. 4; 363(6422):88-91. doi: 10.1126/science.aav7271, the entire contents of each are hereby incorporated by reference.

One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell, 163*, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

```
Wild-type Francisella novicida Cpf1 (D917, E1006, and D1255 are
bolded and underlined)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN
(SEQ ID NO: 80)
Francisella novicida Cpf1 D917A (A917, E1006, and D1255 are
bolded and underlined)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL
```

-continued

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN
(SEQ ID NO: 81)

*Francisella novicida* Cpf1 E1006A (D917, A1006, and D1255 are bolded and underlined)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN
(SEQ ID NO: 82)

*Francisella novicida* Cpf1 D1255A (D917, E1006, and A1255 are bolded and underlined)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

-continued

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN
(SEQ ID NO: 83)

*Francisella novicida* Cpf1 D917A/E1006A (A917, A1006, and D1255 are bolded and underlined)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN
(SEQ ID NO: 84)

*Francisella novicida* Cpf1 D917A/D1255A (A917, E1006, and A1255 are bolded and underlined)
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

-continued

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN
(SEQ ID NO: 85)

*Francisella novicida* Cpf1 E1006A/D1255A (D917, A1006, and A1255 are bolded and underlined)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN
(SEQ ID NO: 86)

*Francisella novicida* Cpf1 D917A/E1006A/D1255A (A917, A1006, and A1255 are bolded and underlined)
```
MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN
(SEQ ID NO: 87)
```

In some embodiments, one of the Cas9 domains present in the fusion protein may be replaced with a guide nucleotide sequence-programmable DNA-binding protein domain that has no requirements for a PAM sequence.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

Exemplary SaCas9 Sequence

```
Exemplary SaCas9 sequence
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK
```

-continued
```
EIFITPHQIKHIKDFKDYKYSHRVDKKPNRELINDTLYSTRKDDKGNTLI
VNNLNGLYDKDNDKLKKLINKSPEKLLMYHHDPQTYQKLKLIMEQYGDEK
NPLYKYYEETGNYLTKYSKKDNGPVIKKIKYYGNKLNAHLDITDDYPNSR
NKVVKLSLKPYRFDVYLDNGVYKFVTVKNLDVIKKENYYEVNSKCYEEAK
KLKKISNQAEFIASFYNNDLIKINGELYRVIGVNNDLLNRIEVNMIDITY
REYLENMNDKRPPRIIKTIASKTQSIKKYSTDILGNLYEVKSKKHPQIIK
KG (SEQ ID NO: 88)
```

Residue N579 above, which is underlined and in bold, may be mutated (e.g., to a A579) to yield a SaCas9 nickase.

```
Exemplary SaCas9n sequence
KRNYILGLDIGITSVGYGIIDYETRDVIDAGVRLFKEANVENNEGRRSKR
GARRLKRRRRHRIQRVKKLLFDYNLLTDHSELSGINPYEARVKGLSQKLS
EEEFSAALLHLAKRRGVHNVNEVEEDTGNELSTKEQISRNSKALEEKYVA
ELQLERLKKDGEVRGSINRFKTSDYVKEAKQLLKVQKAYHQLDQSFIDTY
IDLLETRRTYYEGPGEGSPFGWKDIKEWYEMLMGHCTYFPEELRSVKYAY
NADLYNALNDLNNLVITRDENEKLEYYEKFQIIENVFKQKKKPTLKQIAK
EILVNEEDIKGYRVTSTGKPEFTNLKVYHDIKDITARKEIIENAELLDQI
AKILTIYQSSEDIQEELTNLNSELTQEEIEQISNLKGYTGTHNLSLKAIN
LILDELWHTNDNQIAIFNRLKLVPKKVDLSQQKEIPTTLVDDFILSPVVK
RSFIQSIKVINAIIKKYGLPNDIIIELAREKNSKDAQKMINEMQKRNRQT
NERIEEIIRTTGKENAKYLIEKIKLHDMQEGKCLYSLEAIPLEDLLNNPF
NYEVDHIIPRSVSFDNSFNNKVLVKQEEASKKGNRTPFQYLSSSDSKISY
ETFKKHILNLAKGKGRISKTKKEYLLEERDINRFSVQKDFINRNLVDTRY
ATRGLMNLLRSYFRVNNLDVKVKSINGGFTSFLRRKWKFKKERNKGYKHH
AEDALIIANADFIFKEWKKLDKAKKVMENQMFEEKQAESMPEIETEQEYK
EIFITPHQIKHIKDFKDYKYSHRVDKKPNRELINDTLYSTRKDDKGNTLI
VNNLNGLYDKDNDKLKKLINKSPEKLLMYHHDPQTYQKLKLIMEQYGDEK
NPLYKYYEETGNYLTKYSKKDNGPVIKKIKYYGNKLNAHLDITDDYPNSR
NKVVKLSLKPYRFDVYLDNGVYKFVTVKNLDVIKKENYYEVNSKCYEEAK
KLKKISNQAEFIASFYNNDLIKINGELYRVIGVNNDLLNRIEVNMIDITY
REYLENMNDKRPPRIIKTIASKTQSIKKYSTDILGNLYEVKSKKHPQIIK
KG (SEQ ID NO: 89)
```

Residue A579 above, which can be mutated from N579 to yield a SaCas9 nickase, is underlined and in bold.

```
Exemplary SaKKH Cas9
KRNYILGLDIGITSVGYGIIDYETRDVIDAGVRLFKEANVENNEGRRSKR
GARRLKRRRRHRIQRVKKLLFDYNLLTDHSELSGINPYEARVKGLSQKLS
EEEFSAALLHLAKRRGVHNVNEVEEDTGNELSTKEQISRNSKALEEKYVA
ELQLERLKKDGEVRGSINRFKTSDYVKEAKQLLKVQKAYHQLDQSFIDTY
IDLLETRRTYYEGPGEGSPFGWKDIKEWYEMLMGHCTYFPEELRSVKYAY
NADLYNALNDLNNLVITRDENEKLEYYEKFQIIENVFKQKKKPTLKQIAK
EILVNEEDIKGYRVTSTGKPEFTNLKVYHDIKDITARKEIIENAELLDQI
AKILTIYQSSEDIQEELTNLNSELTQEEIEQISNLKGYTGTHNLSLKAIN
LILDELWHTNDNQIAIFNRLKLVPKKVDLSQQKEIPTTLVDDFILSPVVK
RSFIQSIKVINAIIKKYGLPNDIIIELAREKNSKDAQKMINEMQKRNRQT
NERIEEIIRTTGKENAKYLIEKIKLHDMQEGKCLYSLEAIPLEDLLNNPF
NYEVDHIIPRSVSFDNSFNNKVLVKQEEASKKGNRTPFQYLSSSDSKISY
ETFKKHILNLAKGKGRISKTKKEYLLEERDINRFSVQKDFINRNLVDTRY
ATRGLMNLLRSYFRVNNLDVKVKSINGGFTSFLRRKWKFKKERNKGYKHH
AEDALIIANADFIFKEWKKLDKAKKVMENQMFEEKQAESMPEIETEQEYK
EIFITPHQIKHIKDFKDYKYSHRVDKKPNRKLINDTLYSTRKDDKGNTLI
VNNLNGLYDKDNDKLKKLINKSPEKLLMYHHDPQTYQKLKLIMEQYGDEK
NPLYKYYEETGNYLTKYSKKDNGPVIKKIKYYGNKLNAHLDITDDYPNSR
NKVVKLSLKPYRFDVYLDNGVYKFVTVKNLDVIKKENYYEVNSKCYEEAK
KLKKISNQAEFIASFYKNDLIKINGELYRVIGVNNDLLNRIEVNMIDITY
REYLENMNDKRPPHIIKTIASKTQSIKKYSTDILGNLYEVKSKKHPQIIK
KG (SEQ ID NO: 90).
```

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

In some embodiments, the napDNAbp is a circular permutant. In the following sequences, the plain text denotes an adenosine deaminase sequence, bold sequence indicates sequence derived from Cas9, the italicized sequence denotes a linker sequence, and the underlined sequence denotes a bipartite nuclear localization sequence.

CP5 (with MSP "NGC" PID and "D10A" nickase):
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFMQPTVAYSVLVVAKVEKGKSKKLKSVKELLGITIMERSSFEKN
PIDFLEAKGYKEVKKDLIIKLPKYSLFELENGRKRMLASAKFLQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPRAFKYF
DTTIARKEYRSTKEVLDATLIHQSITGLYETRIDLSQLGGDGGSGGSGGS
GGSGGSGGSGGMDKKYSIGLAIGTNSVGWAVITDEYKVPSKKFKVLGNTD
RHSIKKNLIGALLFDSGETAEATRLKRTARRRYTRRKNRICYLQEIFSNE
MAKVDDSFFHRLEESFLVEEDKKHERHPIFGNIVDEVAYHEKYPTIYHLR
KKLVDSTDKADLRLIYLALAHMIKFRGHFLIEGDLNPDNSDVDKLFIQLV
QTYNQLFEENPINASGVDAKAILSARLSKSRRLENLIAQLPGEKKNGLFG
NLIALSLGLTPNFKSNFDLAEDAKLQLSKDTYDDDLDNLLAQIGDQYADL
FLAAKNLSDAILLSDILRVNTEITKAPLSASMIKRYDEHHQDLTLLKALV
RQQLPEKYKEIFFDQSKNGYAGYIDGGASQEEFYKFIKPILEKMDGTEEL

```
-continued
LVKLNREDLLRKQRTFDNGSIPHQIHLGELHAILRRQEDFYPFLKDNREK

IEKILTFRIPYYVGPLARGNSRFAWMTRKSEETITPWNFEEVVDKGASAQ

SFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRM

NTKYDENDKLIREVKVITLKSKLVSDFRKDFQFYKVREINNYHHAHDAYL

NAVVGTALIKKYPKLESEFVYGDYKVYDVRKMIAKSEQEGADKRTADGSE

FESPKKKRKV* (SEQ ID NO: 12)
```

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system, contains an effector with two predicated HEPN RNase domains. Production of mature CRISPR RNA is tracrRNA-independent, unlike production of CRISPR RNA by Cas12b/C2c1. Cas12b/C2c1 depends on both CRISPR RNA and tracrRNA for DNA cleavage.

The crystal structure of *Alicyclobaccillus acidoterrastris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

A Cas12b/C2c1 ((uniprot.org/uniprot/T0D7A2 #2) sp|T0D7A2|C2C1_ALIAG CRISPR-associated endonuclease C2c1 OS=*Alicyclobacillus acido-terrestris* (strain ATCC 49025/DSM 3922/CIP 106132/NCIMB 13137/GD3B) GN=c2c1 PE=1 SV=1) amino acid sequence is as follows:

```
MAVKSIKVKLRLDDMPEIRAGLWKLHKEVNAGVRYYTEWLSLLRQENLYR

RSPNGDGEQECDKTAEECKAELLERLRARQVENGHRGPAGSDDELLQLAR

QLYELLVPQAIGAKGDAQQIARKFLSPLADKDAVGGLGIAKAGNKPRWVR

MREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKN

RFEQKNFVGQEHLVHLVNQLQQDMKEASPGLESKEQTAHYVTGRALRGSD

KVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNL

LPRDPNEPIALYFRDYGAEQHFTGEFGGAKIQCRRDQLAHMHRRRGARDV

YLNVSVRVQSQSEARGERRPPYAAVFRLVGDNHRAFVHFDKLSDYLAEHP

DDGKLGSEGLLSGLRVMSVDLGLRTSASISVFRVARKDELKPNSKGRVPF

FFPIKGNDNLVAVHERSQLLKLPGETESKDLRAIREERQRTLRQLRTQLA

YLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREH

IDHAKEDRLKKLADRIIMEALGYVYALDERGKGKWVAKYPPCQLILLEEL

SEYQFNNDRPPSENNQLMQWSHRGVFQELINQAQVHDLLVGTMYAAFSSR

FDARTGAPGIRCRRVPARCTQEHNPEPFPWWLNKFVVEHTLDACPLRADD

LIPTGEGEIFVSPFSAEEGDFHQIHADLNAAQNLQQRLWSDFDISQIRLR
```

CDWGEVDGELVLIPRLTGKRTADSYSNKVFYTNTGVTYYERERGKKRRKV

FAQEKLSEEEAELLVEADEAREKSVVLMRDPSGIINRGNWTRQKEFWSMV

NQRIEGYLVKQIRSRVPLQDSACENTGDI (SEQ ID NO: 40)
AacCas12b (Alicydobacillus acidiphilus)-
WP_067623834
MAVKSMKVKLRLDNMPEIRAGLWKLHTEVNAGVRYYTEWLSLLRQENLYR

RSPNGDGEQECYKTAEECKAELLERLRARQVENGHCGPAGSDDELLQLAR

QLYELLVPQAIGAKGDAQQIARKFLSPLADKDAVGGLGIAKAGNKPRWVR

MREAGEPGWEEEKAKAEARKSTDRTADVLRALADFGLKPLMRVYTDSDMS

SVQWKPLRKGQAVRTWDRDMFQQAIERMMSWESWNQRVGEAYAKLVEQKS

RFEQKNFVGQEHLVQLVNQLQQDMKEASHGLESKEQTAHYLTGRALRGSD

KVFEKWEKLDPDAPFDLYDTEIKNVQRRNTRRFGSHDLFAKLAEPKYQAL

WREDASFLTRYAVYNSIVRKLNHAKMFATFTLPDATAHPIWTRFDKLGGN

LHQYTFLFNEFGEGRHAIRFQKLLTVEDGVAKEVDDVTVPISMSAQLDDL

LPRDPHELVALYFQDYGAEQHLAGEFGGAKIQYRRDQLNHLHARRGARDV

YLNLSVRVQSQSEARGERRPPYAAVFRLVGDNHRAFVHFDKLSDYLAEHP

DDGKLGSEGLLSGLRVMSVDLGLRTSASISVFRVARKDELKPNSEGRVPF

CFPIEGNENLVAVHERSQLLKLPGETESKDLRAIREERQRTLRQLRTQLA

YLRLLVRCGSEDVGRRERSWAKLIEQPMDANQMTPDWREAFEDELQKLKS

LYGICGDREWTEAVYESVRRVWRHMGKQVRDWRKDVRSGERPKIRGYQKD

VVGGNSIEQIEYLERQYKFLKSWSFFGKVSGQVIRAEKGSRFAITLREHI

DHAKEDRLKKLADRIIMEALGYVYALDDERGKGKWVAKYPPCQLILLEEL

SEYQFNNDRPPSENNQLMQWSHRGVFQELLNQAQVHDLLVGTMYAAFSSR

FDARTGAPGIRCRRVPARCAREQNPEPFPWWLNKFVAEHKLDGCPLRADD

LIPTGEGEFFVSPFSAEEGDFHQIHADLNAAQNLQRRLWSDFDISQIRLR

CDWGEVDGEPVLIPRTTGKRTADSYGNKVFYTKTGVTYYERERGKKRRKV

FAQEELSEEEAELLVEADEAREKSVVLMRDPSGIINRGDWTRQKEFWSMV

NQRIEGYLVKQIRSRVRLQESACENTGDI (SEQ ID NO: 91)

BhCas12b (Bacillus hisashii) NCBI Reference
Sequence: WP_095142515
MAPKKKRKVGIHGVPAAATRSFILKIEPNEEVKKGLWKTHEVLNHGIAYY

MNILKLIRQEAIYEHHEQDPKNPKKVSKAEIQAELWDFVLKMQKCNSFTH

EVDKDEVFNILRELYEELVPSSVEKKGEANQLSNKFLYPLVDPNSQSGKG

TASSGRKPRWYNLKIAGDPSWEEEKKKWEEDKKKDPLAKILGKLAEYGLI

PLFIPYTDSNEPIVKEIKWMEKSRNQSVRRLDKDMFIQALERFLSWESWN

LKVKEEYEKVEKEYKTLEERIKEDIQALKALEQYEKERQEQLLRDTLNTN

EYRLSKRGLRGWREIIQKWLKMDENEPSEKYLEVFKDYQRKHPREAGDYS

VYEFLSKKENHFIWRNHPEYPYLYATFCEIDKKKKDAKQQATFTLADPIN

HPLWVRFEERSGSNLNKYRILTEQLHTEKLKKKLTVQLDRLIYPTESGGW

EEKGKVDIVLLPSRQFYNQIFLDIEEKGKHAFTYKDESIKFPLKGTLGGA

RVQFDRDHLRRYPHKVESGNVGRIYFNMTVNIEPTESPVSKSLKIHRDDF

PKVVNFKPKELTEWIKDSKGKKLKSGIESLEIGLRVMSIDLGQRQAAAS

IFEVVDQKPDIEGKLFFPIKGTELYAVHRASFNIKLPGETLVKSREVLRK

AREDNLKLMNQKLNFLRNVLHFQQFEDITEREKRVTKWISRQENSDVPLV

YQDELIQIRELMYKPYKDWVAFLKQLHKRLEVEIGKEVKHWRKSLSDGRK

GLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYN

PYEERSRFENSKLMKWSRREIPRQVALQGEIYGLQVGEVGAQFSSRFHAK

TGSPGIRCSVVTKEKLQDNRFFKNLQREGRLTLDKIAVLKEGDLYPDKGG

EKFISLSKDRKCVTTHADINAAQNLQKRFWTRTHGFYKVYCKAYQVDGQT

VYIPESKDQKQKIIEEFGEGYFILKDGVYEWVNAGKLKTKKGSSKQSSSE

LVDSDILKDSFDLASELKGEKLMLYRDPSGNVFPSDKWMAAGVFFGKLER

ILISKLTNQYSISTIEDDSSKQSMKRPAATKKAGQAKKKK
(SEQ ID NO: 45)

Including the variant termed BvCas12b V4 (S893R/K846R/E837G changes rel. to wt above). BhCas12b (V4) is expressed as follows: 5' mRNA Cap---5'UTR---bhCas12b---STOP sequence---3'UTR---120polyA tail 5'UTR ("120polyA tail" disclosed as SEQ ID NO: 372):

GGGAAATAAGAGAGAAAAGAAGAGTAAGAAGAAATATAAGAGCCACC
(SEQ ID NO: 92)

3'UTR (TriLink standard UTR)
GCTGGAGCCTCGGTGGCCATGCTTCTTGCCCCTTGGGCCTCCCCCCAGCC

CCTCCTCCCCTTCCTGCACCCGTACCCCCGTGGTCTTTGAATAAAGTCTG

A (SEQ ID NO: 93)

Nucleic acid sequence of bhCas12b (V4)
ATGGCCCCAAAGAAGAAGCGGAAGGTCGGTATCCACGGAGTCCCAGCAGC

CGCCACCAGATCCTTCATCCTGAAGATCGAGCCCAACGAGGAAGTGAAGA

AAGGCCTCTGGAAAACCCACGAGGTGCTGAACCACGGAATCGCCTACTAC

ATGAATATCCTGAAGCTGATCCGGCAAGAGGCCATCTACGAGCACCACGA

GCAGGACCCCAAGAATCCCAAGAAGGTGTCCAAGGCCGAGATCCAGGCCG

AGCTGTGGGATTTCGTGCTGAAGATGCAGAAGTGCAACAGCTTCACACAC

GAGGTGGACAAGGACGAGGTGTTCAACATCCTGAGAGAGCTGTACGAGGA

ACTGGTGCCCAGCAGCGTGGAAAAGAAGGGCGAAGCCAACCAGCTGAGCA

ACAAGTTTCTGTACCCTCTGGTGGACCCCAACAGCCAGTCTGGAAAGGGA

ACAGCCAGCAGCGGCAGAAAGCCCAGATGGTACAACCTGAAGATTGCCGG

CGATCCCTCCTGGGAAGAAGAAGAAGAAGTGGGAAGAAGATAAGAAA

AGGACCCGCTGGCCAAGATCCTGGGCAAGCTGGCTGAGTACGGACTGATC

CCTCTGTTCATCCCCTACACCGACAGCAACGAGCCCATCGTGAAAGAAAT

CAAGTGGATGGAAAAGTCCCGGAACCAGAGCGTGCGGCGGCTGGATAAGG

ACATGTTCATTCAGGCCCTGGAACGGTTCCTGAGCTGGGAGAGCTGGAAC

CTGAAAGTGAAAGAGGAATACGAGAAGGTCGAGAAAGAGTACAAGACCCT

GGAAGAGAGGATCAAAGAGGACATCCAGGCTCTGAAGGCTCTGGAACAGT

ATGAGAAAGAGCGGCAAGAACAGCTGCTGCGGGACACCCTGAACACCAAC

GAGTACCGGCTGAGCAAGAGAGGCCTTAGAGGCTGGCGGGAAATCATCCA

GAAATGGCTGAAAATGGACGAGAACGAGCCCTCCGAGAAGTACCTGGAAG

-continued

TGTTCAAGGACTACCAGCGGAAGCACCCTAGAGAGGCCGGCGATTACAGC

GTGTACGAGTTCCTGTCCAAGAAAGAGAACCACTTCATCTGGCGGAATCA

CCCTGAGTACCCCTACCTGTACGCCACCTTCTGCGAGATCGACAAGAAAA

AGAAGGACGCCAAGCAGCAGGCCACCTTCACACTGGCCGATCCTATCAAT

CACCCTCTGTGGGTCCGATTCGAGGAAAGAAGCGGCAGCAACCTGAACAA

GTACAGAATCCTGACCGAGCAGCTGCACACCGAGAAGCTGAAGAAAAAGC

TGACAGTGCAGCTGGACCGGCTGATCTACCCTACAGAATCTGGCGGCTGG

GAAGAGAAGGGCAAAGTGGACATTGTGCTGCTGCCCAGCCGGCAGTTCTA

CAACCAGATCTTCCTGGACATCGAGGAAAAGGGCAAGCACGCCTTCACCT

ACAAGGATGAGAGCATCAAGTTCCCTCTGAAGGGCACACTCGGCGGAGCC

AGAGTGCAGTTCGACAGAGATCACCTGAGAAGATACCCTCACAAGGTGGA

AAGCGGCAACGTGGGCAGAATCTACTTCAACATGACCGTGAACATCGAGC

CTACAGAGTCCCCAGTGTCCAAGTCTCTGAAGATCCACCGGGACGACTTC

CCCAAGGTGGTCAACTTCAAGCCCAAAGAACTGACCGAGTGGATCAAGGA

CAGCAAGGGCAAGAAACTGAAGTCCGGCATCGAGTCCCTGGAAATCGGCC

TGAGAGTGATGAGCATCGACCTGGACAGAGACAGGCCGCTGCCGCCTCT

ATTTTCGAGGTGGTGGATCAGAAGCCCGACATCGAAGGCAAGCTGTTTTT

CCCAATCAAGGGCACCGAGCTGTATGCCGTGCACAGAGCCAGCTTCAACA

TCAAGCTGCCCGGCGAGACACTGGTCAAGAGCAGAGAAGTGCTGCGGAAG

GCCAGAGAGGACAATCTGAAACTGATGAACCAGAAGCTCAACTTCCTGCG

GAACGTGCTGCACTTCCAGCAGTTCGAGGACATCACCGAGAGAGAGAGC

GGGTCACCAAGTGGATCAGCAGACAAGAGAACAGCGACGTGCCCCTGGTG

TACCAGGATGAGCTGATCCAGATCCGCGAGCTGATGTACAAGCCTTACAA

GGACTGGGTCGCCTTCCTGAAGCAGCTCCACAAGAGACTGGAAGTCGAGA

TCGGCAAAGAAGTGAAGCACTGGCGGAAGTCCCTGAGCGACGGAAGAAAG

GGCCTGTACGGCATCTCCCTGAAGAACATCGACGAGATCGATCGGACCCG

GAAGTTCCTGCTGAGATGGTCCCTGAGGCCTACCGAACCTGGCGAAGTGC

GTAGACTGGAACCCGGCCAGAGATTCGCCATCGACCAGCTGAATCACCTG

AACGCCCTGAAAGAAGATCGGCTGAAGAAGATGGCCAACACCATCATCAT

GCACGCCCTGGGCTACTGCTACGACGTGCGGAAGAAGAAATGGCAGGCTA

AGAACCCCGCCTGCCAGATCATCCTGTTCGAGGATCTGAGCAACTACAAC

CCCTACGAGGAAAGGTCCCGCTTCGAGAACAGCAAGCTCATGAAGTGGTC

CAGACGCGAGATCCCCAGACAGGTTGCACTGCAGGGCGAGATCTATGGCC

TGCAAGTGGGAGAAGTGGGCGCTCAGTTCAGCAGCAGATTCCACGCCAAG

ACAGGCAGCCCTGGCATCGATGTAGCGTCGTGACCAAAGAGAAGCTGCA

GGACAATCGGTTCTTCAAGAATCTGCAGAGAGGGCAGACTGACCCTGG

ACAAAATCGCCGTGCTGAAAGAGGGCGATCTGTACCCAGACAAAGGCGGC

GAGAAGTTCATCAGCCTGAGCAAGGATCGGAAGTGCGTGACCACACGC

CGACATCAACGCCGCTCAGAACCTGCAGAAGCGGTTCTGGACAAGAACCC

ACGGCTTCTACAAGGTGTACTGCAAGGCCTACCAGGTGGACGCCAGACC

GTGTACATCCCTGAGAGCAAGGACCAGAAGCAGAAGATCATCGAAGAGTT

CGGCGAGGGCTACTTCATTCTGAAGGACGGGGTGTACGAATGGGTCAACG

CCGGCAAGCTGAAAATCAAGAAGGGCAGCTCCAAGCAGAGCAGCAGCGAG

CTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCC

CCAGCGACAAATGGATGGCCGCTGGCGTGTTCTTCGGAAAGCTGGAACGC

ATCCTGATCAGCAAGCTGACCAACCAGTACTCCATCAGCACCATCGAGGA

CGACAGCAGCAAGCAGTCTATGAAAAGGCCGGCGGCCACGAAAAGGCCG

GCCAGGCAAAAAAGAAAAAG (SEQ ID NO: 94)

In some embodiments, the Cas12b is BvCas12B. In some embodiments, the Cas12b comprises amino acid substitutions S893R, K846R, and E837G as numbered in BvCas12B exemplary sequence provided below.

BvCas12b (Bacillus sp. V3-13) NCBI Reference
Sequence: WP_101661451.1
MAIRSIKLKMKTNSGTDSIYLRKALWRTHQLINEGIAYYMNLLTLYRQEA

IGDKTKEAYQAELINIIRNQQRNNGSSEEHGSDQEILALLRQLYELIIPS

SIGESGDANQLGNKFLYPLVDPNSQSGKGTSNAGRKPRWKRLKEEGNPDW

ELEKKKDEERKAKDPTVKIFDNLNKYGLLPLFPLFTNIQKDIEWLPLGKR

QSVRKWDKDMFIQAIERLLSWESWNRRVADEYKQLKEKTESYYKEHLTGG

EEWIEKIRKFEKERNMELEKNAFAPNDGYFITSRQIRGWDRVYEKWSKLP

ESASPEELWKVVAEQQNKMSEGFGDPKVFSFLANRENRDIWRGHSERIYH

IAAYNGLQKKLSRTKEQATFTLPDAIEHPLWIRYESPGGTNLNLFKLEEK

QKKNYYVTLSKIIWPSEEKWIEKENIEIPLAPSIQFNRQIKLKQHVKGKQ

EISFSDYSSRISLDGVLGGSRIQFNRKYIKNHKELLGEGDIGPVFFNLVV

DVAPLQETRNGRLQSPIGKALKVISSDFSKVIDYKPKELMDWMNTGSASN

SFGVASLLEGMRVMSIDMGQRTSASVSIFEVVKELPKDQEQKLFYSINDT

ELFAIHKRSFLLNLPGEVVTKNNKQQRQERRKKRQFVRSQIRMLANVLRL

ETKKTPDERKKAIHKLMEIVQSYDSWTASQKEVWEKELNLLTNMAAFNDE

IWKESLVELHHRIEPYVGQIVSKWRKGLSEGRKNLAGISMWNIDELEDTR

RLLISWSKRSRTPGEANRIETDEPFGSSLLQHIQNVKDDRLKQMANLIIM

TALGFKYDKEEKDRYKRWKETYPACQIILFENLNRYLFNLDRSRRENSRL

MKWAHRSIPRTVSMQGEMFGLQVGDVRSEYSSRFHAKTGAPGIRCHALTE

EDLKAGSNTLKRLIEDGFINESELAYLKKGDIIPSQGGELFVTLSKRYKK

DSDNNELTVIHADINAAQNLQKRFWQQNSEVYRVPCQLARMGEDKLYIPK

SQTETIKKYFGKGSFVKNNTEQEVYKWEKSEKMKIKTDTTFDLQDLDGFE

DISKTIELAQEQQKKYLTMFRDPSGYFFNNETWRPQKEYWSIVNNIIKSC

LKKKILSNKVEL (SEQ ID NO: 95)

In some embodiments, the Cas12b is BTCas12b. BTCas12b (*Bacillus thermoamylovorans*) NCBI Reference Sequence: WP_041902512

MATRSFILKIEPNEEVKKGLWKTHEVLNHGIAYYMNILKLIRQEAIYEHH

EQDPKNPKKVSKAEIQAELWDFVLKMQKCNSFTHEVDKDVVFNILRELYE

```
ELVPSSVEKKGEANQLSNKFLYPLVDPNSQSGKGTASSGRKPRWYNLKIA
GDPSWEEEKKKWEEDKKKDPLAKILGKLAEYGLIPLFIPFTDSNEPIVKE
IKWMEKSRNQSVRRLDKDMFIQALERFLSWESWNLKVKEEYEKVEKEHKT
LEERIKEDIQAFKSLEQYEKERQEQLLRDTLNTNEYRLSKRGLRGWREII
QKWLKMDENEPSEKYLEVFKDYQRKHPREAGDYSVYEFLSKKENHFIWRN
HPEYPYLYATFCEIDKKKKDAKQQATFTLADPINHPLWVRFEERSGSNLN
KYRILTEQLHTEKLKKKLTVQLDRLIYPTESGGWEEKGKVDIVLLPSRQF
YNQIFLDIEEKGKHAFTYKDESIKFPLKGTLGGARVQFDRDHLRRYPHKV
ESGNVGRIYFNMTVNIEPTESPVSKSLKIHRDDFPKFVNFKPKELTEWIK
DSKGKKLKSGIESLEIGLRVMSIDLGQRQAAAASIFEVVDQKPDIEGKLF
FPIKGTELYAVHRASFNIKLPGETLVKSREVLRKAREDNLKLMNQKLNFL
RNVLHFQQFEDITEREKRVTKWISRQENSDVPLVYQDELIQIRELMYKPY
KDWVAFLKQLHKRLEVEIGKEVKHWRKSLSDGRKGLYGISLKNIDEIDRT
RKFLLRWSLRPTEPGEVRRLEPGQRFAIDQLNHLNALKEDRLKKMANTII
MHALGYCYDVRKKKWQAKNPACQIILFEDLSNYNPYEERSRFENSKLMKW
SRREIPRQVALQGEIYGLQVGEVGAQFSSRFHAKTGSPGIRCSVVTKEKL
QDNRFFKNLQREGRLTLDKIAVLKEGDLYPDKGGEKFISLSKDRKLVTTH
ADINAAQNLQKRFWTRTHGFYKVYCKAYQVDGQTVYIPESKDQKQKIIEE
FGEGYFILKDGVYEWGNAGKLKTKKGSSKQSSSELVDSDILKDSFDLASE
LKGEKLMLYRDPSGNVFPSDKWMAAGVFFGKLERILISKLTNQYSISTIE
DDSSKQSM (SEQ ID NO: 96)
```

In some embodiments, a napDNAbp refers to Cas12c. In some embodiments, the Cas12c protein is a Cas12c1 or a variant of Cas12c1. In some embodiments, the Cas12 protein is a Cas12c2 or a variant of Cas12c2. In some embodiments, the Cas12 protein is a Cas12c protein from *Oleiphilus* sp. H10009 (i.e., OspCas12c) or a variant of OspCas12c. These Cas12c molecules have been described in Yan et al., "Functionally Diverse Type V CRISPR-Cas Systems," Science, 2019 Jan. 4; 363: 88-91; the entire contents of which is hereby incorporated by reference. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12c1, Cas12c2, or OspCas12c protein. In some embodiments, the napDNAbp is a naturally-occurring Cas12c1, Cas12c2, or OspCas12c protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12c1, Cas12c2, or OspCas12c protein described herein. It should be appreciated that Cas12c1, Cas12c2, or OspCas12c from other bacterial species may also be used in accordance with the present disclosure.

```
Cas12c1
MQTKKTHLHLISAKASRKYRRTIACLSDTAKKDLERRKQSGAADPAQELS
CLKTIKFKLEVPEGSKLPSFDRISQIYNALETIEKGSLSYLLFALILSGF
RIFPNSSAAKTFASSSCYKNDQFASQIKEIFGEMVKNFIPSELESILKKG
RRKNNKDWTEENIKRVLNSEFGRKNSEGSSALFDSFLSKFSQELFRKFDS
WNEVNKKYLEAAELLDSMLASYGPFDSVCKMIGDSDSRNSLPDKSTIAFT
NNAEITVDIESSVMPYMAIAALLREYRQSKSKAAPVAYVQSHLTTINGNG
LSWFFKFGLDLIRKAPVSSKQSTSDGSKSLQELFSVPDDKLDGLKFIKEA
CEALPEASLLCGEKGELLGYQDFRTSFAGHIDSWVANYVNRLFELIELVN
QLPESIKLPSILTQKNHNLVASLGLQEAEVSHSLELFEGLVKNVRQTLKK
LAGIDISSSPNEQDIKEFYAFSDVLNRLGSIRNQIENAVQTAKKDKIDLE
SAIEWKEWKKLKKLPKLNGLGGGVPKQQELLDKALESVKQIRHYQRIDFE
RVIQWAVNEHCLETVPKFLVDAEKKKINKESSTDFAAKENAVRFLLEGIG
AAARGKTDSVSKAAYNWFVVNNFLAKKDLNRYFINCQGCIYKPPYSKRRS
LAFALRSDNKDTIEVVWEKFETFYKEISKEIEKFNIFSQEFQTFLHLENL
RMKLLLRRIQKPIPAEIAFFSLPQEYYDSLPPNVAFLALNQEITPSEYIT
QFNLYSSFLNGNLILLRRSRSYLRAKFSWVGNSKLIYAAKEARLWKIPNA
YWKSDEWKMILDSNVLVFDKAGNVLPAPTLKKVCEREGDLRLFYPLLRQL
PHDWCYRNPFVKSVGREKNVIEVNKEGEPKVASALPGSLFRLIGPAPFKS
LLDDCFFNPLDKDLRECMLIVDQEISQKVEAQKVEASLESCTYSIAVPIR
YHLEEPKVSNQFENVLAIDQGEAGLAYAVFSLKSIGEAETKPIAVGTIRI
PSIRRLIHSVSTYRKKKQRLQNFKQNYDSTAFIMRENVTGDVCAKIVGLM
KEFNAFPVLEYDVKNLESGSRQLSAVYKAVNSHFLYFKEPGRDALRKQLW
YGGDSWTIDGIEIVTRERKEDGKEGVEKIVPLKVFPGRSVSARFTSKTCS
CCGRNVFDWLFTEKKAKTNKKFNVNSKGELTTADGVIQLFEADRSKGPKF
YARRKERTPLTKPIAKGSYSLEEIERRVRTNLRRAPKSKQSRDTSQSQYF
CVYKDCALHFSGMQADENAAINIGRRFLTALRKNRRSDFPSNVKISDRLL
DN (SEQ ID NO: 97)

Cas12c2
MTKHSIPLHAFRNSGADARKWKGRIALLAKRGKETMRTLQFPLEMSEPEA
AAINTTPFAVAYNAIEGTGKGTLFDYWAKLHLAGFRFFPSGGAATIFRQQ
AVFEDASWNAAFCQQSGKDWPWLVPSKLYERFTKAPREVAKKDGSKKSIE
FTQENVANESHVSLVGASITDKTPEDQKEFFLKMAGALAEKFDSWKSANE
DRIVAMKVIDEFLKSEGLHLPSLENIAVKCSVETKPDNATVAWHDAPMSG
VQNLAIGVFATCASRIDNIYDLNGGKLSKLIQESATTPNVTALSWLFGKG
LEYPRTTDIDTIMQDFNIPASAKESIKPLVESAQAIPTMTVLGKKNYAPF
RPNFGGKIDSWIANYASRLMLLNDILEQIEPGFELPQALLDNETLMSGID
MTGDELKELIEAVYAWVDAAKQGLATLLGRGGNVDDAVQTFEQFSAMMDT
LNGTLNTISARYVRAVEMAGKDEARLEKLIECKFDIPKWCKSVPKLVGIS
GGLPKVEEEIKVMNAAFKDVRARMFVRFEEIAAYVASKGAGMDVYDALEK
RELEQIKKLKSAVPERAHIQAYRAVLHRIGRAVQNCSEKTKQLFSSKVIE
MGVFKNPSHLNNFIFNQKGAIYRSPFDRSRHAPYQLHADKLLKNDWLELL
AEISATLMASESTEQMEDALRLERTRLQLQLSGLPDWEYPASLAKPDIEV
EIQTALKMQLAKDTVTSDVLQRAFNLYSSVLSGLTFKLLRRSFSLKMRFS
```

```
VADTTQLIYVPKVCDWAIPKQYLQAEGEIGIAARVVTESSPAKMVTEVEM

KEPKALGHFMQQAPHDWYFDASLGGTQVAGRIVEKGKEVGKERKLVGYRM

RGNSAYKTVLDKSLVGNTELSQCSMIIEIPYTQTVDADFRAQVQAGLPKV

SINLPVKETITASNKDEQMLFDRFVAIDLGERGLGYAVFDAKTLELQESG

HRPIKAITNLLNRTHHYEQRPNQRQKFQAKFNVNLSELRENTVGDVCHQI

NRICAYYNAFPVLEYMVPDRLDKQLKSVYESVTNRYIWSSTDAHKSARVQ

FWLGGETWEHPYLKSAKDKKPLVLSPGRGASGKGTSQTCSCCGRNPFDLI

KDMKPRAKIAVVDGKAKLENSELKLFERNLESKDDMLARRHRNERAGMEQ

PLTPGNYTVDEIKALLRANLRRAPKNRRTKDTTVSEYHCVFSDCGKTMHA

DENAAVNIGGKFIADIEK (SEQ ID NO: 98)

OspCas12c
MTKLRHRQKKLTHDWAGSKKREVLGSNGKLQNPLLMPVKKGQVTEFRKAF

SAYARATKGEMTDGRKNMFTHSFEPFKTKPSLHQCELADKAYQSLHSYLP

GSLAHFLLSAHALGFRIFSKSGEATAFQASSKIEAYESKLASELACVDLS

IQNLTISTLFNALTTSVRGKGEETSADPLIARFYTLLTGKPLSRDTQGPE

RDLAEVISRKIASSFGTWKEMTANPLQSLQFFEEELHALDANVSLSPAFD

VLIKMNDLQGDLKNRTIVFDPDAPVFEYNAEDPADIIKLTARYAKEAVI

KNQNVGNYVKNAITTTNANGLGWLLNKGLSLLPVSTDDELLEFIGVERSH

PSCHALIELIAQLEAPELFEKNVFSDTRSEVQGMIDSAVSNHIARLSSSR

NSLSMDSEELERLIKSFQIHTPHCSLFIGAQSLSQQLESLPEALQSGVNS

ADILLGSTQYMLTNSLVEESIATYQRTLNRINYLSGVAGQINGAIKRKAI

DGEKIHLPAAWSELISLPFIGQPVIDVESDLAHLKNQYQTLSNEFDTLIS

ALQKNFDLNFNKALLNRTQHFEAMCRSTKKNALSKPEIVSYRDLLARLTS

CLYRGSLVLRRAGIEVLKKHKIFESNSELREHVHERKHFVFVSPLDRKAK

KLLRLTDSRPDLLHVIDEILQHDNLENKDRESLWLVRSGYLLAGLPDQLS

SSFINLPIITQKGDRRLIDLIQYDQINRDAFVMLVTSAFKSNLSGLQYRA

NKQSFVVTRTLSPYLGSKLVYVPKDKDWLVPSQMFEGRFADILQSDYMVW

KDAGRLCVIDTAKHLSNIKKSVFSSEEVLAFLRELPHRTFIQTEVRGLGV

NVDGIAFNNGDIPSLKTFSNCVQVKVSRTNTSLVQTLNRWFEGGKVSPPS

IQFERAYYKKDDQIHEDAAKRKIRFQMPATELVHASDDAGWTPSYLLGID

PGEYGMGLSLVSINNGEVLDSGFIHINSLINFASKKSNHQTKVVPRQQYK

SPYANYLEQSKDSAAGDIAHILDRLIYKLNALPVFEALSGNSQSAADQVW

TKVLSFYTWGDNDAQNSIRKQHWFGASHWDIKGMLRQPPTEKKPKPYIAF

PGSQVSSYGNSQRCSCCGRNPIEQLREMAKDTSIKELKIRNSEIQLFDGT

IKLFNPDPSTVIERRRHNLGPSRIPVADRTFKNISPSSLEFKELITIVSR

SIRHSPEFIAKKRGIGSEYFCAYSDCNSSLNSEANAAANVAQKFQKQLFF

EL (SEQ ID NO: 99)
```

In some embodiments, a napDNAbp refers to Cas12g, Cas12h, or Cas12i, which have been described in, for example, Yan et al., "Functionally Diverse Type V CRISPR-Cas Systems," Science, 2019 Jan. 4; 363: 88-91; the entire contents of each is hereby incorporated by reference. By aggregating more than 10 terabytes of sequence data, new classifications of Type V Cas proteins were identified that showed weak similarity to previously characterized Class V protein, including Cas12g, Cas12h, and Cas12i. In some embodiments, the Cas12 protein is a Cas12g or a variant of Cas12g. In some embodiments, the Cas12 protein is a Cas12h or a variant of Cas12h. In some embodiments, the Cas12 protein is a Cas12i or a variant of Cas12i. It should be appreciated that other RNA-guided DNA binding proteins may be used as a napDNAbp, and are within the scope of this disclosure. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12g, Cas12h, or Cas12i protein. In some embodiments, the napDNAbp is a naturally-occurring Cas12g, Cas12h, or Cas12i protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any Cas12g, Cas12h, or Cas12i protein described herein. It should be appreciated that Cas12g, Cas12h, or Cas12i from other bacterial species may also be used in accordance with the present disclosure. In some embodiments, the Cas12i is a Cas12i1 or a Cas12i2.

```
Cas12g1
MAQASSTPAVSPRPRPRYREERTLVRKLLPRPGQSKQEFRENVKKLRKAF

LQFNADVSGVCQWAIQFRPRYGKPAEPTETFWKFFLEPETSLPPNDSRSP

EFRRLQAFEAAAGINGAAALDDPAFTNELRDSILAVASRPKTKEAQRLFS

RLKDYQPAHRMILAKVAAEWIESRYRRAHQNWERNYEEWKKEKQEWEQNH

PELTPEIREAFNQIFQQLEVKEKRVRICPAARLLQNKDNCQYAGKNKHSV

LCNQFNEFKKNHLQGKAIKFFYKDAEKYLRCGLQSLKPNVQGPFREDWNK

YLRYMNLKEETLRGKNGGRLPHCKNLGQECEFNPHTALCKQYQQQLSSRP

DLVQHDELYRKWRREYWREPRKPVFRYPSVKRHSIAKIFGENYFQADFKN

SVVGLRLDSMPAGQYLEFAFAPWPRNYRPQPGETEISSVHLHFVGTRPRI

GFRFRVPHKRSRFDCTQEELDELRSRTFPRKAQDQKFLEAARKRLLETFP

GNAEQELRLLAVDLGTDSARAAFFIGKTFQQAFPLKIVKIEKLYEQWPNQ

KQAGDRRDASSKQPRPGLSRDHVGRHLQKMRAQASEIAQKRQELTGTPAP

ETTTDQAAKKATLQPFDLRGLTVHTARMIRDWARLNARQIIQLAEENQVD

LIVLESLRGFRPPGYENLDQEKKRRVAFFAHGRIRRKVTEKAVERGMRVV

TVPYLASSKVCAECRKKQKDNKQWEKNKKRGLFKCEGCGSQAQVDENAAR

VLGRVFWGEIELPTAIP (SEQ ID NO: 100)

Cas12h1
MKVHEIPRSQLLKIKQYEGSFVEWYRDLQEDRKKFASLLFRWAAFGYAAR

EDDGATYISPSQALLERRLLLGDAEDVAIKFLDVLFKGGAPSSSCYSLFY

EDFALRDKAKYSGAKREFIEGLATMPLDKIIERIRQDEQLSKIPAEEWLI

LGAEYSPEEIWEQVAPRIVNVDRSLGKQLRERLGIKCRRPHDAGYCKILM

EVVARQLRSHNETYHEYLNQTHEMKTKVANNLTNEFDLVCEFAEVLEEKN

YGLGWYVLWQGVKQALKEQKKPTKIQIAVDQLRQPKFAGLLTAKWRALKG

AYDTWKLKKRLEKRKAFPYMPNWDNDYQIPVGLTGLGVFTLEVKRTEVVV
```

DLKEHGKLFCSHSHYFGDLTAEKHPSRYHLKFRHKLKLRKRDSRVEPTIG

PWIEAALREITIQKKPNGVFYLGLPYALSHGIDNFQIAKRFFSAAKPDKE

VINGLPSEMVVGAADLNLSNIVAPVKARIGKGLEGPLHALDYGYGELIDG

PKILTPDGPRCGELISLKRDIVEIKSAIKEFKACQREGLTMSEETTTWLS

EVESPSDSPRCMIQSRIADTSRRLNSFKYQMNKEGYQDLAEALRLLDAMD

SYNSLLESYQRMHLSPGEQSPKEAKFDTKRASFRDLLRRRVAHTIVEYFD

DCDIVFFEDLDGPSDSDSRNNALVKLLSPRTLLLYIRQALEKRGIGMVEV

AKDGTSQNNPISGHVGWRNKQNKSEIYFYEDKELLVMDADEVGAMNILCR

GLNHSVCPYSFVTKAPEKKNDEKKEGDYGKRVKRFLKDRYGSSNVRFLVA

SMGFVTVTTKRPKDALVGKRLYYHGGELVTHDLHNRMKDEIKYLVEKEVL

ARRVSLSDSTIKSYKSFAHV (SEQ ID NO: 101)

Cas12i1
MSNKEKNASETRKAYTTKMIPRSHDRMKLLGNFMDYLMDGTPIFFELWNQ

FGGGIDRDIISGTANKDKISDDLLLAVNWFKVMPINSKPQGVSPSNLANL

FQQYSGSEPDIQAQEYFASNFDTEKHQWKDMRVEYERLLAELQLSRSDMH

HDLKLMYKEKCIGLSLSTAHYITSVMFGTGAKNNRQTKHQFYSKVIQLLE

ESTQINSVEQLASIILKAGDCDSYRKLRIRCSRKGATPSILKIVQDYELG

TNHDDEVNVPSLIANLKEKLGRFEYECEWKCMEKIKAFLASKVGPYYLGS

YSAMLENALSPIKGMTTKNCKFVLKQIDAKNDIKYENEPFGKIVEGFFDS

PYFESDTNVKWVLHPHHIGESNIKTLWEDLNAIHSKYEEDIASLSEDKKE

KRIKVYQGDVCQTINTYCEEVGKEAKTPLVQLLRYLYSRKDDIAVDKIID

GITFLSKKHKVEKQKINPVIQKYPSFNFGNNSKLLGKIISPKDKLKHNLK

CNRNQVDNYIWIEIKVLNTKTMRWEKHHYALSSTRFLEEVYYPATSENPP

DALAARFRTKTNGYEGKPALSAEQIEQIRSAPVGLRKVKKRQMRLEAARQ

QNLLPRYTWGKDFNINICKRGNNFEVTLATKVKKKKEKNYKVVLGYDANI

VRKNTYAAIEAHANGDGVIDYNDLPVKPIESGFVTVESQVRDKSYDQLSY

NGVKLLYCKPHVESRRSFLEKYRNGTMKDNRGNNIQIDFMKDFEAIADDE

TSLYYFNMKYCKLLQSSIRNHSSQAKEYREEIFELLRDGKLSVLKLSSLS

NLSFVMFKVAKSLIGTYFGHLLKKPKNSKSDVKAPPITDEDKQKADPEMF

ALRLALEEKRLNKVKSKKEVIANKIVAKALELRDKYGPVLIKGENISDTT

KKGKKSSTNSFLMDWLARGVANKVKEMVMMHQGLEFVEVNPNFTSHQDPF

VHKNPENTFRARYSRCTPSELTEKNRKEILSFLSDKPSKRPTNAYYNEGA

MAFLATYGLKKNDVLGVSLEKFKQIMANILHQRSEDQLLFPSRGGMFYLA

TYKLDADATSVNWNGKQFWVCNADLVAAYNVGLVDIQKDFKKK
(SEQ ID NO: 102)

Cas12i2
MSSAIKSYKSVLRPNERKNQLLKSTIQCLEDGSAFFFKMLQGLFGGITPE

IVRFSTEQEKQQQDIALWCAVNWFRPVSQDSLTHTIASDNLVEKFEEYYG

GTASDAIKQYFSASIGESYYWNDCRQQYYDLCRELGVEVSDLTHDLEILC

REKCLAVATESNQNNSIISVLFGTGEKEDRSVKLRITKKILEAISNLKEI

PKNVAPIQEIILNVAKATKETFRQVYAGNLGAPSTLEKFIAKDGQKEFDL

KKLQTDLKKVIRGKSKERDWCCQEELRSYVEQNTIQYDLWAWGEMFNKAH

TALKIKSTRNYNFAKQRLEQFKEIQSLNNLLVVKKLNDFFDSEFFSGEET

YTICVHHLGGKDLSKLYKAWEDDPADPENAIVVLCDDLKNNFKKEPIRNI

LRYIFTIRQECSAQDILAAAKYNQQLDRYKSQKANPSVLGNQGFTWTNAV

ILPEKAQRNDRPNSLDLRIWLYLKLRHPDGRWKKHHIPFYDTRFFQEIYA

AGNSPVDTCQFRTPRFGYHLPKLTDQTAIRVNKKHVKAAKTEARIRLAIQ

QGTLPVSNLKITEISATINSKGQVRIPVKFDVGRQKGTLQIGDRFCGYDQ

NQTASHAYSLWEVVKEGQYHKELGCFVRFISSGDIVSITENRGNQFDQLS

YEGLAYPQYADWRKKASKFVSLWQITKKNKKKEIVTVEAKEKFDAICKYQ

PRLYKFNKEYAYLLRDIVRGKSLVELQQIRQEIFRFIEQDCGVTRLGSLS

LSTLETVKAVKGIIYSYFSTALNASKNNPISDEQRKEFDPELFALLEKLE

LIRTRKKKQKVERIANSLIQTCLENNIKFIRGEGDLSTTNNATKKKANSR

SMDWLARGVFNKIRQLAPMHNITLFGCGSLYTSHQDPLVHRNPDKAMKCR

WAAIPVKDIGDWVLRKLSQNLRAKNIGTGEYYHQGVKEFLSHYELQDLEE

ELLKWRSDRKSNIPCWVLQNRLAEKLGNKEAVVYIPVRGGRIYFATHKVA

TGAVSIVFDQKQVWVCNADHVAAANIALTVKGIGEQSSDEENPDGSRIKL

QLTS (SEQ ID NO: 103)

Representative nucleic acid and protein sequences of the base editors follow:

```
BhCas12b GGSGGS-ABE8-Xten20 at P153
GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCggaggctctggaggaagcTCCGAAGTCGAGTTTTCCCATGAGTAC
```

```
TGGATGAGACACGCATTGACTCTCGCAAAGAGGGCTCGAGATGAACGCGAGGTGCCCGTGGG

GGCAGTACTCGTGCTCAACAATCGCGTAATCGGCGAAGGTTGGAATAGGGCAATCGGACTCC

ACGACCCCACTGCACATGCGGAAATCATGGCCCTTCGACAGGGAGGGCTTGTGATGCAGAAT

TATCGACTTTATGATGCGACGCTGTACGTCACGTTTGAACCTTGCGTAATGTGCGCGGGAGC

TATGATTCACTCCCGCATTGGACGAGTTGTATTCGGTGTTCGCAACGCCAAGACGGGTGCCG

CAGGTTCACTGATGGACGTGCTGCATCATCCAGGCATGAACCACCGGGTAGAAATCACAGAA

GGCATATTGGCGGACGAATGTGCGGCGCTGTTGTGTCGTTTTTTTCGCATGCCCAGGCGGGT

CTTTAACGCCCAGAAAAAGCACAATCCTCTACTGACGGCTCTTCTGGATCTGAAACACCTG

GCACAAGCGAGAGCGCCACCCCTGAGAGCTCTGGCTCCTGGGAAGAAGAGAAGAAGAAGTGG

GAAGAAGATAAGAAAAAGGACCCGCTGGCCAAGATCCTGGGCAAGCTGGCTGAGTACGGACT

GATCCCTCTGTTCATCCCCTACACCGACAGCAACGAGCCCATCGTGAAAGAAATCAAGTGGA

TGGAAAAGTCCCGGAACCAGAGCGTGCGGCGGCTGGATAAGGACATGTTCATTCAGGCCCTG

GAACGGTTCCTGAGCTGGGAGAGCTGGAACCTGAAAGTGAAAGAGGAATACGAGAAGGTCGA

GAAAGAGTACAAGACCCTGGAAGAGAGGATCAAAGAGGACATCCAGGCTCTGAAGGCTCTGG

AACAGTATGAGAAAGAGCGGCAAGAACAGCTGCTGCGGGACACCCTGAACACCAACGAGTAC

CGGCTGAGCAAGAGAGGCCTTAGAGGCTGGCGGGAAATCATCCAGAAATGGCTGAAAATGGA

CGAGAACGAGCCCTCCGAGAAGTACCTGGAAGTGTTCAAGGACTACCAGCGGAAGCACCCTA

GAGAGGCCGGCGATTACAGCGTGTACGAGTTCCTGTCCAAGAAAGAGAACCACTTCATCTGG

CGGAATCACCCTGAGTACCCCTACCTGTACGCCACCTTCTGCGAGATCGACAAGAAAAAGAA

GGACGCCAAGCAGCAGGCCACCTTCACACTGGCCGATCCTATCAATCACCCTCTGTGGGTCC

GATTCGAGGAAAGAAGCGGCAGCAACCTGAACAAGTACAGAATCCTGACCGAGCAGCTGCAC

ACCGAGAAGCTGAAGAAAAAGCTGACAGTGCAGCTGGACCGGCTGATCTACCCTACAGAATC

TGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGC

ATCAAGTTCCCTCTGAAGGGCACACTCGGCGGAGCCAGAGTGCAGTTCGACAGAGATCACCT

GAGAAGATACCCTCACAAGGTGGAAAGCGGCAACGTGGGCAGAATCTACTTCAACATGACCG

TGAACATCGAGCCTACAGAGTCCCCAGTGTCCAAGTCTCTGAAGATCCACCGGGACGACTTC

CCCAAGGTGGTCAACTTCAAGCCCAAAGAACTGACCGAGTGGATCAAGGACAGCAAGGGCAA

GAAACTGAAGTCCGGCATCGAGTCCCTGGAAATCGGCCTGAGAGTGATGAGCATCGACCTGG

GACAGAGACAGGCCGCTGCCGCCTCTATTTTCGAGGTGGTGGATCAGAAGCCCGACATCGAA

GGCAAGCTGTTTTTCCCAATCAAGGGCACCGAGCTGTATGCCGTGCACAGAGCCAGCTTCAA

CATCAAGCTGCCCGGCGAGACACTGGTCAAGAGCAGAGAAGTGCTGCGGAAGGCCAGAGAGG

ACAATCTGAAACTGATGAACCAGAAGCTCAACTTCCTGCGGAACGTGCTGCACTTCCAGCAG

TTCGAGGACATCACCGAGAGAGAGAAGCGGGTCACCAAGTGGATCAGCAGACAAGAGAACAG

CGACGTGCCCCTGGTGTACCAGGATGAGCTGATCCAGATCCGCGAGCTGATGTACAAGCCTT

ACAAGGACTGGGTCGCCTTCCTGAAGCAGCTCCACAAGAGACTGGAAGTCGAGATCGGCAAA

GAAGTGAAGCACTGGCGGAAGTCCCTGAGCGACGGAAGAAAGGGCCTGTACGGCATCTCCCT

GAAGAACATCGACGAGATCGATCGGACCCGGAAGTTCCTGCTGAGATGGTCCCTGAGGCCTA

CCGAACCTGGCGAAGTGCGTAGACTGGAACCCGGCCAGAGATTCGCCATCGACCAGCTGAAT
```

```
CACCTGAACGCCCTGAAAGAAGATCGGCTGAAGAAGATGGCCAACACCATCATCATGCACGC
CCTGGGCTACTGCTACGACGTGCGGAAGAAGAAATGGCAGGCTAAGAACCCCGCCTGCCAGA
TCATCCTGTTCGAGGATCTGAGCAACTACAACCCCTACGAGGAAAGGTCCCGCTTCGAGAAC
AGCAAGCTCATGAAGTGGTCCAGACGCGAGATCCCCAGACAGGTTGCACTGCAGGGCGAGAT
CTATGGCCTGCAAGTGGGAGAAGTGGGCGCTCAGTTCAGCAGCAGATTCCACGCCAAGACAG
GCAGCCCTGGCATCAGATGTAGCGTCGTGACCAAAGAGAAGCTGCAGGACAATCGGTTCTTC
AAGAATCTGCAGAGAGAGGGCAGACTGACCCTGGACAAAATCGCCGTGCTGAAAGAGGGCGA
TCTGTACCCAGACAAAGGCGGCGAGAAGTTCATCAGCCTGAGCAAGGATCGGAAGTGCGTGA
CCACACACGCCGACATCAACGCCGCTCAGAACCTGCAGAAGCGGTTCTGGACAAGAACCCAC
GGCTTCTACAAGGTGTACTGCAAGGCCTACCAGGTGGACGCCAGACCGTGTACATCCCT
GAGAGCAAGGACCAGAAGCAGAAGATCATCGAAGAGTTCGGCGAGGGCTACTTCATTCTGAA
GGACGGGGTGTACGAATGGGTCAACGCCGGCAAGCTGAAAATCAAGAAGGGCAGCTCCAAGC
AGAGCAGCAGCGAGCTGGTGGATAGCGACATCCTGAAAGACAGCTTCGACCTGGCCTCCGAG
CTGAAAGGCGAAAAGCTGATGCTGTACAGGGACCCCAGCGGCAATGTGTTCCCCAGCGACAA
ATGGATGGCCGCTGGCGTGTTCTTCGGAAAGCTGGAACGCATCCTGATCAGCAAGCTGACCA
ACCAGTACTCCATCAGCACCATCGAGGACGACAGCAGCAAGCAGTCTATG<u>AAAAGGCCGGCG</u>
<u>GCCACGAAAAAGGCCGGCCAGGCAAAAAAGAAAAAGG</u>GATCC*TACCCATACGATGTTCCAGA*
*TTACGCTTATCCCTACGACGTGCCTGATTATGCATACCCATATGATGTCCCCGACTATGCCT*
AA (SEQ ID NO: 104)

MAPKKKRKVGIHGVPAAATRSFILKIEPNEEVKKGLWKTHEVLNHGIAYYMNILKLIRQEAI
YEHHEQDPKNPKKVSKAEIQAELWDFVLKMQKCNSFTHEVDKDEVFNILRELYEELVPSSVE
KKGEANQLSNKFLYPLVDPNSQSGKGTASSGRKPRWYNLKIAGDPGGSGGSSEVEFSHEYWM
RHALTLAKRARDEREVPVGAVLVLNNRVIGEGWNRAIGLHDPTAHAEIMALRQGGLVMQNYR
LYDATLYVTFEPCVMCAGAMIHSRIGRVVFGVRNAKTGAAGSLMDVLHHPGMNHRVEITEGI
LADECAALLCRFFRMPRRVFNAQKKAQSSTDGSSGSETPGTSESATPESSGSWEEEKKKWEE
DKKKDPLAKILGKLAEYGLIPLFIPYTDSNEPIVKEIKWMEKSRNQSVRRLDKDMFIQALER
FLSWESWNLKVKEEYEKVEKEYKTLEERIKEDIQALKALEQYEKERQEQLLRDTLNTNEYRL
SKRGLRGWREIIQKWLKMDENEPSEKYLEVFKDYQRKHPREAGDYSVYEFLSKKENHFIWRN
HPEYPYLYATFCEIDKKKKDAKQQATFTLADPINHPLWVRFEERSGSNLNKYRILTEQLHTE
KLKKKLPVQLDRLIYPTESGGWEEKGKVDIVLLPSRQFYNQIFLDIEEKGKHAFTYKDESIK
FPLKGTLGGARVQFDRDHLRRYPHKVESGNVGRIYFNMTVNIEPTESPVSKSLKIHRDDFPK
VVNFKPKELTEWIKDSKGKKLKSGIESLEIGLRVMSIDLGQRQAAAASIFEVVDQKPDIEGK
LFFPIKGTELYAVHRASFNIKLPGETLVKSREVLRKAREDNLKLMNQKLNFLRNVLHFQQFE
DITEREKRVTKWISRQENSDVPLVYQDELIQIRELMYKPYKDWVAFLKQLHKRLEVEIGKEV
KHWRKSLSDGRKGLYGISLKNIDEIDRTRKFLLRWSLRPTEPGEVRRLEPGQRFAIDQLNHL
NALKEDRLKKMANTIIMHALGYCYDVRKKKWQAKNPACQIILFEDLSNYNPYEERSRFENSK
LMKWSRREIPRQVALQGEIYGLQVGEVGAQFSSRFHAKTGSPGIRCSVVTKEKLQDNRFFKN
LQREGRLTLKDIAVLKEGDLYPDKGGEKFISLSKDRKCVTTHADINAAQNLQKRFWTRTHGF
```

YKVYCKAYQVDGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA
(SEQ ID NO: 105)

BhCas12b GGSGGS-ABE8-Xten20 at K255
GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGGATCAAAggaggctctggaggaagcTCCGAAGTCGAGTTTTCCCATGAGTACT

GGATGAGACACGCATTGACTCTCGCAAAGAGGGCTCGAGATGAACGCGAGGTGCCCGTGGGG

GCAGTACTCGTGCTCAACAATCGCGTAATCGGCGAAGGTTGGAATAGGGCAATCGGACTCCA

CGACCCCACTGCACATGCGGAAATCATGGCCCTTCGACAGGGAGGGCTTGTGATGCAGAATT

ATCGACTTTATGATGCGACGCTGTACGTCACGTTTGAACCTTGCGTAATGTGCGCGGGAGCT

ATGATTCACTCCCGCATTGGACGAGTTGTATTCGGTGTTCGCAACGCCAAGACGGGTGCCGC

AGGTTCACTGATGGACGTGCTGCATCATCCAGGCATGAACCACCGGGTAGAAATCACAGAAG

GCATATTGGCGGACGAATGTGCGGCGCTGTTGTGTCGTTTTTTTCGCATGCCCAGGCGGGTC

TTTAACGCCCAGAAAAAAGCACAATCCTCTACTGACGGCTCTTCTGGATCTGAAACACCTGG

CACAAGCGAGAGCGCCACCCCTGAGAGCTCTGGCGAGGACATCCAGGCTCTGAAGGCTCTGG

AACAGTATGAGAAAGAGCGGCAAGAACAGCTGCTGCGGGACACCCTGAACACCAACGAGTAC

CGGCTGAGCAAGAGAGGCCTTAGAGGCTGGCGGGAAATCATCCAGAAATGGCTGAAAATGGA

CGAGAACGAGCCCTCCGAGAAGTACCTGGAAGTGTTCAAGGACTACCAGCGGAAGCACCCTA

GAGAGGCCGGCGATTACAGCGTGTACGAGTTCCTGTCCAAGAAAGAGAACCACTTCATCTGG

CGGAATCACCCTGAGTACCCCTACCTGTACGCCACCTTCTGCGAGATCGACAAGAAAAAGAA

GGACGCCAAGCAGCAGGCCACCTTCACACTGGCCGATCCTATCAATCACCCTCTGTGGGTCC

GATTCGAGGAAAGAAGCGGCAGCAACCTGAACAAGTACAGAATCCTGACCGAGCAGCTGCAC

ACCGAGAAGCTGAAGAAAAGCTGACAGTGCAGCTGGACCGGCTGATCTACCCTACAGAATC

TGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGC

ATCAAGTTCCCTCTGAAGGGCACACTCGGCGGAGCCAGAGTGCAGTTCGACAGAGATCACCT

-continued

```
GAGAAGATACCCTCACAAGGTGGAAAGCGGCAACGTGGGCAGAATCTACTTCAACATGACCG

TGAACATCGAGCCTACAGAGTCCCCAGTGTCCAAGTCTCTGAAGATCCACCGGGACGACTTC

CCCAAGGTGGTCAACTTCAAGCCCAAAGAACTGACCGAGTGGATCAAGGACAGCAAGGGCAA

GAAACTGAAGTCCGGCATCGAGTCCCTGGAAATCGGCCTGAGAGTGATGAGCATCGACCTGG

GACAGAGACAGGCCGCTGCCGCCTCTATTTTCGAGGTGGTGGATCAGAAGCCCGACATCGAA

GGCAAGCTGTTTTTCCCAATCAAGGGCACCGAGCTGTATGCCGTGCACAGAGCCAGCTTCAA

CATCAAGCTGCCCGGCGAGACACTGGTCAAGAGCAGAGAAGTGCTGCGGAAGGCCAGAGAGG

ACAATCTGAAACTGATGAACCAGAAGCTCAACTTCCTGCGGAACGTGCTGCACTTCCAGCAG

TTCGAGGACATCACCGAGAGAGAGAAGCGGGTCACCAAGTGGATCAGCAGACAAGAGAACAG

CGACGTGCCCCTGGTGTACCAGGATGAGCTGATCCAGATCCGCGAGCTGATGTACAAGCCTT

ACAAGGACTGGGTCGCCTTCCTGAAGCAGCTCCACAAGAGACTGGAAGTCGAGATCGGCAAA

GAAGTGAAGCACTGGCGGAAGTCCCTGAGCGACGAAGAAAGGGCCTGTACGGCATCTCCCT

GAAGAACATCGACGAGATCGATCGGACCCGGAAGTTCCTGCTGAGATGGTCCCTGAGGCCTA

CCGAACCTGGCGAAGTGCGTAGACTGGAACCCGGCCAGAGATTCGCCATCGACCAGCTGAAT

CACCTGAACGCCCTGAAAGAAGATCGGCTGAAGAAGATGGCCAACACCATCATCATGCACGC

CCTGGGCTACTGCTACGACGTGCGGAAGAAGAAATGGCAGGCTAAGAACCCCGCCTGCCAGA

TCATCCTGTTCGAGGATCTGAGCAACTACAACCCCTACGAGGAAAGGTCCCGCTTCGAGAAC

AGCAAGCTCATGAAGTGGTCCAGACGCGAGATCCCCAGACAGGTTGCACTGCAGGGCGAGAT

CTATGGCCTGCAAGTGGGAGAAGTGGGCGCTCAGTTCAGCAGCAGATTCCACGCCAAGACAG

GCAGCCCTGGCATCAGATGTAGCGTCGTGACCAAAGAGAAGCTGCAGGACAATCGGTTCTTC

AAGAATCTGCAGAGAGAGGGCAGACTGACCCTGGACAAAATCGCCGTGCTGAAAGAGGGCGA

TCTGTACCCAGACAAAGGCGGCGAGAAGTTCATCAGCCTGAGCAAGGATCGGAAGTGCGTGA

CCACACACGCCGACATCAACGCCGCTCAGAACCTGCAGAAGCGGTTCTGGACAAGAACCCAC

GGCTTCTACAAGGTGTACTGCAAGGCCTACCAGGTGGACGGCCAGACCGTGTACATCCCTGA

GAGCAAGGACCAGAAGCAGAAGATCATCGAAGAGTTCGGCGAGGGCTACTTCATTCTGAAGG

ACGGGGTGTACGAATGGGTCAACGCCGGCAAGCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

CAGTACTCCATCAGCACCATCGAGGACGACAGCAGCAAGCAGTCTATGAAAAGGCCGGCGGC

CACGAAAAAGGCCGGCCAGGCAAAAAAGAAAAAGGGATCCTACCCATACGATGTTCCAGATT

ACGCTTATCCCTACGACGTGCCTGATTATGCATACCCATATGATGTCCCCGACTATGCCTAA
(SEQ ID NO: 106)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKGGSGGSSEVEFSHEYWMRHALTLAKRARDEREVPVGAV

LVLNNRVIGEGWNRAIGLDDPTAHAEIMALRQGGLVMQNYRLYDATLYVTFEPCVMCAGAMI

HSRIGRVVFGVRNAKTGAAGSLMDVLHHPGMNHRVEITEGILADECAALLCRFFRMPRRVFN

AQKKAQSSTDGSSGSETPGTSESATPESSGEDIQALKALEQYEKERQEQLLRDTLNTNEYRL
```

-continued

```
SKRGLRGWREIIQKWLKMDENEPSEKYLEVFDKYQRKHPREAGDYSVYEFLSKKENHFIWRN

HPEYPYLYATFCEIDKKKKDAKQQATFTLADPINHPLWVRFEERSGSNLNKYRILTEQLHTE

KLKKKLTVQLDRLIYPTESGGWEEKGKVDIVLLPSRQFYNQIFLDIEEKGKHAFTYKDESIK

FPLKGTLGGARVQFDRDHLRRYPHKVESGNVGRIYFNMTVNIEPTESPVSKSLKIHRDDFPK

VVNFKPKELTEWIKDSKGKKLKSGIESLEIGLRVMSIDLGQRQAAAASIFEVVDQKPDIEGK

LFFPIKGTELYAVHRASFNIKLPGETLVKSREVLRKAREDNLKLMNQKLNFLRNVLHFQQFE

DITEREKRVTKWISRQENSDVPLVYQDELIQIRELMYKPYKDWVAFLKQLHKRLEVEIGKEV

KHWRKSLSDGRKGLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYNPYEERSRFENSK

LMKWSRREIPRQVALQGEIYGLQVGEVGAQFSSRFHAKTGSPGIRCSVVTKEKLQDNRFFKN

LQREGRLTLDKIAVLKEGDLYPDKGGEKFISLSKDRKCVTTHADINAAQNLQKRFWTRTHGF

YKVYCKAYQVDGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA
(SEQ ID NO: 107)

BhCas12b GGSGGS-ABE8-Xten20 at D306
GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGAGGATCAAAGAGGACATCCAGGCTCTGAAGGCTCTGGAACAGTATGAGAAAGAGC

GGCAAGAACAGCTGCTGCGGGACACCCTGAACACCAACGAGTACCGGCTGAGCAAGAGAGGC

CTTAGAGGCTGGCGGGAAATCATCCAGAAATGGCTGAAAATGGACggaggctctggaggaag cTCCGAAGTCGAGTTTTCCCATGAGTACTGGATGAGACACGCATTGACTCTCGCAAAGAGGG

CTCGAGATGAACGCGAGGTGCCCGTGGGGGCAGTACTCGTGCTCAACAATCGCGTAATCGGC

GAAGGTTGGAATAGGGCAATCGGACTCCACGACCCCACTGCACATGCGGAAATCATGGCCCT

TCGACAGGGAGGGCTTGTGATGCAGAATTATCGACTTTATGATGCGACGCTGTACGTCACGT

TTGAACCTTGCGTAATGTGCGCGGGAGCTATGATTCACTCCCGCATTGGACGAGTTGTATTC

GGTGTTCGCAACGCCAAGACGGGTGCCGCAGGTTCACTGATGGACGTGCTGCATCATCCAGG

CATGAACCACCGGGTAGAAATCACAGAAGGCATATTGGCGGACGAATGTGCGGCGCTGTTGT
```

-continued

GTCGTTTTTTTCGCATGCCCAGGCGGGTCTTTAACGCCCAGAAAAAAGCACAATCCTCTACT

GACGGCTCTTCTGGATCTGAAACACCTGGCACAAGCGAGAGCGCCACCCCTGAGAGCTCTGG

CGAGAACGAGCCCTCCGAGAAGTACCTGGAAGTGTTCAAGGACTACCAGCGGAAGCACCCTA

GAGAGGCCGGCGATTACAGCGTGTACGAGTTCCTGTCCAAGAAAGAGAACCACTTCATCTGG

CGGAATCACCCTGAGTACCCCTACCTGTACGCCACCTTCTGCGAGATCGACAAGAAAAAGAA

GGACGCCAAGCAGCAGGCCACCTTCACACTGGCCGATCCTATCAATCACCCTCTGTGGGTCC

GATTCGAGGAAAGAAGCGGCAGCAACCTGAACAAGTACAGAATCCTGACCGAGCAGCTGCAC

ACCGAGAAGCTGAAGAAAAAGCTGACAGTGCAGCTGGACCGGCTGATCTACCCTACAGAATC

TGGCGGCTGGGAAGAGAAGGGCAAAGTGGACATTGTGCTGCTGCCCAGCCGGCAGTTCTACA

ACCAGATCTTCCTGGACATCGAGGAAAAGGGCAAGCACGCCTTCACCTACAAGGATGAGAGC

ATCAAGTTCCCTCTGAAGGGCACACTCGGCGGAGCCAGAGTGCAGTTCGACAGAGATCACCT

GAGAAGATACCCTCACAAGGTGGAAAGCGGCAACGTGGGCAGAATCTACTTCAACATGACCG

TGAACATCGAGCCTACAGAGTCCCCAGTGTCCAAGTCTCTGAAGATCCACCGGGACGACTTC

CCCAAGGTGGTCAACTTCAAGCCCAAAGAACTGACCGAGTGGATCAAGGACAGCAAGGGCAA

GAAACTGAAGTCCGGCATCGAGTCCCTGGAAATCGGCCTGAGAGTGATGAGCATCGACCTGG

GACAGAGACAGGCCGCTGCCGCCTCTATTTTCGAGGTGGTGGATCAGAAGCCCGACATCGAA

GGCAAGCTGTTTTTCCCAATCAAGGGCACCGAGCTGTATGCCGTGCACAGAGCCAGCTTCAA

CATCAAGCTGCCCGGCGAGACACTGGTCAAGAGCAGAGAAGTGCTGCGGAAGGCCAGAGAGG

ACAATCTGAAACTGATGAACCAGAAGCTCAACTTCCTGCGGAACGTGCTGCACTTCCAGCAG

TTCGAGGACATCACCGAGAGAGAGAAGCGGGTCACCAAGTGGATCAGCAGACAAGAGAACAG

CGACGTGCCCCTGGTGTACCAGGATGAGCTGATCCAGATCCGCGAGCTGATGTACAAGCCTT

ACAAGGACTGGGTCGCCTTCCTGAAGCAGCTCCACAAGAGACTGGAAGTCGAGATCGGCAAA

GAAGTGAAGCACTGGCGGAAGTCCCTGAGCGACGGAAGAAAGGGCCTGTACGGCATCTCCCT

GAAGAACATCGACGAGATCGATCGGACCCGGAAGTTCCTGCTGAGATGGTCCCTGAGGCCTA

CCGAACCTGGCGAAGTGCGTAGACTGGAACCCGGCCAGAGATTCGCCATCGACCAGCTGAAT

CACCTGAACGCCCTGAAAGAAGATCGGCTGAAGAAGATGGCCAACACCATCATCATGCACGC

CCTGGGCTACTGCTACGACGTGCGGAAGAAGAAATGGCAGGCTAAGAACCCCGCCTGCCAGA

TCATCCTGTTCGAGGATCTGAGCAACTACAACCCCTACGAGGAAAGGTCCCGCTTCGAGAAC

AGCAAGCTCATGAAGTGGTCCAGACGCGAGATCCCCAGACAGGTTGCACTGCAGGGCGAGAT

CTATGGCCTGCAAGTGGGAGAAGTGGGCGCTCAGTTCAGCAGCAGATTCCACGCCAAGACAG

GCAGCCCTGGCATCAGATGTAGCGTCGTGACCAAAGAGAAGCTGCAGGACAATCGGTTCTTC

AAGAATCTGCAGAGAGAGGGCAGACTGACCCTGGACAAAATCGCCGTGCTGAAAGAGGGCGA

TCTGTACCCAGACAAAGGCGGCGAGAAGTTCATCAGCCTGAGCAAGGATCGGAAGTGCGTGA

CCACACACGCCGACATCAACGCCGCTCAGAACCTGCAGAAGCGGTTCTGGACAAGAACCCAC

GGCTTCTACAAGGTGTACTGCAAGGCCTACCAGGTGGACGGCCAGACCGTGTACATCCCTGA

GAGCAAGGACCAGAAGCAGAAGATCATCGAAGAGTTCGGCGAGGGCTACTTCATTCTGAAGG

ACGGGGTGTACGAATGGGTCAACGCCGGCAAGCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

-continued

CAGTACTCCATCAGCACCATCGAGGACGACAGCAGCAAGCAGTCTATG<u>AAAAGGCCGGCGGC</u>
<u>CACGAAAAAGGCCGGCCAGGCAAAAAAGAAAAAGG</u>GATCC *TACCCATACGATGTTCCAGATT*
*ACGCTTATCCCTACGACGTGCCTGATTATGCATACCCATATGATGTCCCCGACTATGCC*TAA
(SEQ ID NO: 108)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDGGSGGSSEVEFSHEYWMRHALTLAKRARDEREVPVGAVLVLNNRVIGEG

WNRAIGLHDPTAHAEIMALRQGGLVMQNYRLYDATLYVTFEPCVMCAGAMIHSRIGRVVFGV

RNAKTGAAGSLMDVLHHPGMNHRVEITEGILADECAALLCRFFRMPRRVFNAQKKAQSSTDG

SSGSETPGTSESATPESSGENEPSEKYLEVFKDYQRKHPREAGDYSVYEFLSKKENHFIWRN

HPEYPYLYATFCEIDKKKKDAKQQATFTLADPINHPLWVRFEERSGSNLNKYRILTEQLHTE

KLKKKLTVQLDRLIYPTESGGWEEKGKVDIVLLPSRQFYNQIFLDIEEKGKHAFTYKDESIK

FPLKGTLGGARVQFDRDHLRRYPHKVESGNVGRIYFNMTVNIEPTESPVSKSLKIHRDDFPK

VVNFKPKELTEWIKDSKGKKLKSGIESLEIGLRVMSIDLGQRQAAAASIFEVVDQKPDIEGK

LFFPIKGTELYAVHRASFNIKLPGETLVKSREVLRKAREDNLKLMNQKLNFLRNVLHFQQFE

DITEREKRVTKWISRQENSDVPLVYQDELIQIRELMYKPYKDWVAFLKQLHKRLEVEIGKEV

KHWRKSLSDGRKGLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYNPYEERSRFENSK

LMKWSRREIPRQVALQGEIYGLQVGEVGAQFSSRFHAKTGSPGIRCSVVTKEKLQDNRFFKN

LQREGRLTLDKIAVLKEGDLYPDKGGEKFISLSKDRKCVTTHADINAAQNLQKRFWTRTHGF

YKVYCKAYQVDGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA
(SEQ ID NO: 109)

BhCas12b GGSGGS-ABE8-Xten20 at D980
GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGAGGATCAAAGAGGACATCCAGGCTCTGAAGGCTCTGGAACAGTATGAGAAAGAGC

-continued

```
GGCAAGAACAGCTGCTGCGGGACACCCTGAACACCAACGAGTACCGGCTGAGCAAGAGAGGC

CTTAGAGGCTGGCGGGAAATCATCCAGAAATGGCTGAAAATGGACGAGAACGAGCCCTCCGA

GAAGTACCTGGAAGTGTTCAAGGACTACCAGCGGAAGCACCCTAGAGAGGCCGGCGATTACA

GCGTGTACGAGTTCCTGTCCAAGAAAGAGAACCACTTCATCTGGCGGAATCACCCTGAGTAC

CCCTACCTGTACGCCACCTTCTGCGAGATCGACAAGAAAAAGAAGGACGCCAAGCAGCAGGC

CACCTTCACACTGGCCGATCCTATCAATCACCCTCTGTGGGTCCGATTCGAGGAAAGAAGCG

GCAGCAACCTGAACAAGTACAGAATCCTGACCGAGCAGCTGCACACCGAGAAGCTGAAGAAA

AAGCTGACAGTGCAGCTGGACCGGCTGATCTACCCTACAGAATCTGGCGGCTGGGAAGAGAA

GGGCAAAGTGGACATTGTGCTGCTGCCCAGCCGGCAGTTCTACAACCAGATCTTCCTGGACA

TCGAGGAAAAGGGCAAGCACGCCTTCACCTACAAGGATGAGAGCATCAAGTTCCCTCTGAAG

GGCACACTCGGCGGAGCCAGAGTGCAGTTCGACAGAGATCACCTGAGAAGATACCCTCACAA

GGTGGAAAGCGGCAACGTGGGCAGAATCTACTTCAACATGACCGTGAACATCGAGCCTACAG

AGTCCCCAGTGTCCAAGTCTCTGAAGATCCACCGGGACGACTTCCCCAAGGTGGTCAACTTC

AAGCCCAAAGAACTGACCGAGTGGATCAAGGACAGCAAGGGCAAGAAACTGAAGTCCGGCAT

CGAGTCCCTGGAAATCGGCCTGAGAGTGATGAGCATCGACCTGGGACAGAGACAGGCCGCTG

CCGCCTCTATTTTCGAGGTGGTGGATCAGAAGCCCGACATCGAAGGCAAGCTGTTTTTCCCA

ATCAAGGGCACCGAGCTGTATGCCGTGCACAGAGCCAGCTTCAACATCAAGCTGCCCGGCGA

GACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAG

AGAGAGAAGCGGGTCACCAAGTGGATCAGCAGACAAGAGAACAGCGACGTGCCCCTGGTGTA

CCAGGATGAGCTGATCCAGATCCGCGAGCTGATGTACAAGCCTTACAAGGACTGGGTCGCCT

TCCTGAAGCAGCTCCACAAGAGACTGGAAGTCGAGATCGGCAAAGAAGTGAAGCACTGGCGG

AAGTCCCTGAGCGACGGAAGAAAGGGCCTGTACGGCATCTCCCTGAAGAACATCGACGAGAT

CGATCGGACCCGGAAGTTCCTGCTGAGATGGTCCCTGAGGCCTACCGAACCTGGCGAAGTGC

GTAGACTGGAACCCGGCCAGAGATTCGCCATCGACCAGCTGAATCACCTGAACGCCCTGAAA

GAAGATCGGCTGAAGAAGATGGCCAACACCATCATCATGCACGCCCTGGGCTACTGCTACGA

CGTGCGGAAGAAGAAATGGCAGGCTAAGAACCCCGCCTGCCAGATCATCCTGTTCGAGGATC

TGAGCAACTACAACCCCTACGAGGAAAGGTCCCGCTTCGAGAACAGCAAGCTCATGAAGTGG

TCCAGACGCGAGATCCCCAGACAGGTTGCACTGCAGGGCGAGATCTATGGCCTGCAAGTGGG

AGAAGTGGGCGCTCAGTTCAGCAGCAGATTCCACGCCAAGACAGGCAGCCCTGGCATCAGAT

GTAGCGTCGTGACCAAAGAGAAGCTGCAGGACAATCGGTTCTTCAAGAATCTGCAGAGAGAG

GGCAGACTGACCCTGGACAAAATCGCCGTGCTGAAAGAGGGCGATCTGTACCCAGACAAAGG

CGGCGAGAAGTTCATCAGCCTGAGCAAGGATCGGAAGTGCGTGACCACACACGCCGACATCA

ACGCCGCTCAGAACCTGCAGAAGCGGTTCTGGACAAGAACCCACGGCTTCTACAAGGTGTAC

TGCAAGGCCTACCAGGTGGACggaggctctggaggaagcTCCGAAGTCGAGTTTTCCCATGA

GTACTGGATGAGACACGCATTGACTCTCGCAAAGAGGGCTCGAGATGAACGCGAGGTGCCCG

TGGGGGCAGTACTCGTGCTCAACAATCGCGTAATCGGCGAAGGTTGGAATAGGGCAATCGGA

CTCCACGACCCCACTGCACATGCGGAAATCATGGCCCTTCGACAGGGAGGGCTTGTGATGCA

GAATTATCGACTTTATGATGCGACGCTGTACGTCACGTTTGAACCTTGCGTAATGTGCGCGG
```

-continued

GAGCTATGATTCACTCCCGCATTGGACGAGTTGTATTCGGTGTTCGCAACGCCAAGACGGGT

GCCGCAGGTTCACTGATGGACGTGCTGCATCATCCAGGCATGAACCACCGGGTAGAAATCAC

AGAAGGCATATTGGCGGACGAATGTGCGGCGCTGTTGTGTCGTTTTTTTCGCATGCCCAGGC

GGGTCTTTAACGCCCAGAAAAAAGCACAATCCTCTACTGACGGCTCTTCTGGATCTGAAACA

CCTGGCACAAGCGAGAGCGCCACCCCTGAGAGCTCTGGCGGCCAGACCGTGTACATCCCTGA

GAGCAAGGACCAGAAGCAGAAGATCATCGAAGAGTTCGGCGAGGGCTACTTCATTCTGAAGG

ACGGGGTGTACGAATGGGTCAACGCCGGCAAGCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

CAGTACTCCATCAGCACCATCGAGGACGACAGCAGCAAGCAGTCTATGAAAAGGCCGGCGGC

CACGAAAAAGGCCGGCCAGGCAAAAAAGAAAAAGGGATCCTACCCATACGATGTTCCAGATT

ACGCTTATCCCTACGACGTGCCTGATTATGCATACCCATATGATGTCCCCGACTATGCCTAA
(SEQ ID NO: 110)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDENEPSEKYLEVFKDYQRKHPREAGDYSVYEFLSKKENHFIWRNHPEYPY

LYATFCEIDKKKKDAKQQATFTLADPINHPLWVRFEERSGSNLNKYRILTEQLHTEKLKKKL

TVQLDRLIYPTESGGWEEKGKVDIVLLPSRQFYNQIFLDIEEKGKHAFTYKDESIKFPLKGT

LGGARVQFDRDHLRRYPHKVESGNVGRIYFNMTVNIEPTESPVSKSLKIHRDDFPKVVNFKP

KELTEWIKDSKGKKLKSGIESLEIGLRVMSIDLGQRQAAAASIFEVVDQKPDIEGKLFFPIK

GTELYAVHRASFNIKLPGETLVKSREVLRKAREDNLKLMNQKLNFLRNVLHFQQFEDITERE

KRVTKWISRQENSDVPLVYQDELIQIRELMYKPYKDWVAFLKQLHKRLEVEIGKEVKHWRKS

LSDGRKGLYGISLKNIDEIDRTRKFLLRWSLRPTEPGEVRRLEPGQRFAIDQLNHLNALKED

RLKKMANTIIMHALGYCYDVRKKKWQAKNPACQIILFEDLSNYNPYEERSRFENSKLMKWSR

REIPRQVALQGEIYGLQVGEVGAQFSSRFHAKTGSPGIRCSVVTKEKLQDNRFFKNLQREGR

LTLDKIAVLKEGDLYPDKGGEKFISLSKDRKCVTTHADINAAQNLQKRFWTRTHGFYKVYCK

AYQVDGGSGGSSEVEFSHEYWMRHALTLAKRARDEREVPVGAVLVLVVRVIGEGWNRAIGLH

DPTAHAEIMALRQGGLVMQNYRLYDATLYVTFEPCVMCAGAMIHSRIGRVVFGVRNAKTGAA

GSLMDVLHHPGMNHRVEITEGILADECAALLCRFFRMPRRVFNAQKKAQSSTDGSSGSETPG

TSESATPESSGGQTVYIPESKDQKQKIIEEFGEGYFILKDGVYEWVNAGKLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA
(SEQ ID NO: 111)

BhCas12b GGSGGS-ABE8-Xten20 at K1019
GCCACCATGGCCCCAAAGAAGAAGCGGAAGGTCGGTATCCACGGAGTCCCAGCAGCCGCCAC

CAGATCCTTCATCCTGAAGATCGAGCCCAACGAGGAAGTGAAGAAAGGCCTCTGGAAAACCC

ACGAGGTGCTGAACCACGGAATCGCCTACTACATGAATATCCTGAAGCTGATCCGGCAAGAG

-continued

```
GCCATCTACGAGCACCACGAGCAGGACCCCAAGAATCCCAAGAAGGTGTCCAAGGCCGAGAT

CCAGGCCGAGCTGTGGGATTTCGTGCTGAAGATGCAGAAGTGCAACAGCTTCACACACGAGG

TGGACAAGGACGAGGTGTTCAACATCCTGAGAGAGCTGTACGAGGAACTGGTGCCCAGCAGC

GTGGAAAAGAAGGGCGAAGCCAACCAGCTGAGCAACAAGTTTCTGTACCCTCTGGTGGACCC

CAACAGCCAGTCTGGAAAGGGAACAGCCAGCAGCGGCAGAAAGCCCAGATGGTACAACCTGA

AGATTGCCGGCGATCCCTCCTGGGAAGAAGAGAAGAAGAAGTGGGAAGAAGATAAGAAAAAG

GACCCGCTGGCCAAGATCCTGGGCAAGCTGGCTGAGTACGGACTGATCCCTCTGTTCATCCC

CTACACCGACAGCAACGAGCCCATCGTGAAAGAAATCAAGTGGATGGAAAAGTCCCGGAACC

AGAGCGTGCGGCGGCTGGATAAGGACATGTTCATTCAGGCCCTGGAACGGTTCCTGAGCTGG

GAGAGCTGGAACCTGAAAGTGAAAGAGGAATACGAGAAGGTCGAGAAAGAGTACAAGACCCT

GGAAGAGAGGATCAAAGAGGACATCCAGGCTCTGAAGGCTCTGGAACAGTATGAGAAAGAGC

GGCAAGAACAGCTGCTGCGGGACACCCTGAACACCAACGAGTACCGGCTGAGCAAGAGAGGC

CTTAGAGGCTGGCGGGAAATCATCCAGAAATGGCTGAAAATGGACGAGAACGAGCCCTCCGA

GAAGTACCTGGAAGTGTTCAAGGACTACCAGCGGAAGCACCCTAGAGAGGCCGGCGATTACA

GCGTGTACGAGTTCCTGTCCAAGAAAGAGAACCACTTCATCTGGCGGAATCACCCTGAGTAC

CCCTACCTGTACGCCACCTTCTGCGAGATCGACAAGAAAAAGAAGGACGCCAAGCAGCAGGC

CACCTTCACACTGGCCGATCCTATCAATCACCCTCTGTGGGTCCGATTCGAGGAAAGAAGCG

GCAGCAACCTGAACAAGTACAGAATCCTGACCGAGCAGCTGCACACCGAGAAGCTGAAGAAA

AAGCTGACAGTGCAGCTGGACCGGCTGATCTACCCTACAGAATCTGGCGGCTGGGAAGAGAA

GGGCAAAGTGGACATTGTGCTGCTGCCCAGCCGGCAGTTCTACAACCAGATCTTCCTGGACA

TCGAGGAAAAGGGCAAGCACGCCTTCACCTACAAGGATGAGAGCATCAAGTTCCCTCTGAAG

GGCACACTCGGCGGAGCCAGAGTGCAGTTCGACAGAGATCACCTGAGAAGATACCCTCACAA

GGTGGAAAGCGGCAACGTGGGCAGAATCTACTTCAACATGACCGTGAACATCGAGCCTACAG

AGTCCCCAGTGTCCAAGTCTCTGAAGATCCACCGGGACGACTTCCCCAAGGTGGTCAACTTC

AAGCCCAAAGAACTGACCGAGTGGATCAAGGACAGCAAGGGCAAGAAACTGAAGTCCGGCAT

CGAGTCCCTGGAAATCGGCCTGAGAGTGATGAGCATCGACCTGGGACAGAGACAGGCCGCTG

CCGCCTCTATTTTCGAGGTGGTGGATCAGAAGCCCGACATCGAAGGCAAGCTGTTTTTCCCA

ATCAAGGGCACCGAGCTGTATGCCGTGCACAGAGCCAGCTTCAACATCAAGCTGCCCGGCGA

GACACTGGTCAAGAGCAGAGAAGTGCTGCGGAAGGCCAGAGAGGACAATCTGAAACTGATGA

ACCAGAAGCTCAACTTCCTGCGGAACGTGCTGCACTTCCAGCAGTTCGAGGACATCACCGAG

AGAGAGAAGCGGGTCACCAAGTGGATCAGCAGACAAGAGAACAGCGACGTGCCCCTGGTGTA

CCAGGATGAGCTGATCCAGATCCGCGAGCTGATGTACAAGCCTTACAAGGACTGGGTCGCCT

TCCTGAAGCAGCTCCACAAGAGACTGGAAGTCGAGATCGGCAAAGAAGTGAAGCACTGGCGG

AAGTCCCTGAGCGACGGAAGAAAGGGCCTGTACGGCATCTCCCTGAAGAACATCGACGAGAT

CGATCGGACCCGGAAGTTCCTGCTGAGATGGTCCCTGAGGCCTACCGAACCTGGCGAAGTGC

GTAGACTGGAACCCGGCCAGAGATTCGCCATCGACCAGCTGAATCACCTGAACGCCCTGAAA

GAAGATCGGCTGAAGAAGATGGCCAACACCATCATCATGCACGCCCTGGGCTACTGCTACGA

CGTGCGGAAGAAGAAATGGCAGGCTAAGAACCCCGCCTGCCAGATCATCCTGTTCGAGGATC

TGAGCAACTACAACCCCTACGAGGAAAGGTCCCGCTTCGAGAACAGCAAGCTCATGAAGTGG

TCCAGACGCGAGATCCCCAGACAGGTTGCACTGCAGGGCGAGATCTATGGCCTGCAAGTGGG
```

-continued

AGAAGTGGGCGCTCAGTTCAGCAGCAGATTCCACGCCAAGACAGGCAGCCCTGGCATCAGAT

GTAGCGTCGTGACCAAAGAGAAGCTGCAGGACAATCGGTTCTTCAAGAATCTGCAGAGAGAG

GGCAGACTGACCCTGGACAAAATCGCCGTGCTGAAAGAGGGCGATCTGTACCCAGACAAAGG

CGGCGAGAAGTTCATCAGCCTGAGCAAGGATCGGAAGTGCGTGACCACACACGCCGACATCA

ACGCCGCTCAGAACCTGCAGAAGCGGTTCTGGACAAGAACCCACGGCTTCTACAAGGTGTAC

TGCAAGGCCTACCAGGTGGACGGCCAGACCGTGTACATCCCTGAGAGCAAGGACCAGAAGCA

GAAGATCATCGAAGAGTTCGGCGAGGGCTACTTCATTCTGAAGGACGGGGTGTACGAATGGG

TCAACGCCGGCAAGggaggctctggaggaagcTCCGAAGTCGAGTTTTCCCATGAGTACTGG

ATGAGACACGCATTGACTCTCGCAAAGAGGGCTCGAGATGAACGCGAGGTGCCCGTGGGGGC

AGTACTCGTGCTCAACAATCGCGTAATCGGCGAAGGTTGGAATAGGGCAATCGGACTCCACG

ACCCCACTGCACATGCGGAAATCATGGCCCTTCGACAGGGAGGGCTTGTGATGCAGAATTAT

CGACTTTATGATGCGACGCTGTACGTCACGTTTGAACCTTGCGTAATGTGCGCGGGAGCTAT

GATTCACTCCCGCATTGGACGAGTTGTATTCGGTGTTCGCAACGCCAAGACGGGTGCCGCAG

GTTCACTGATGGACGTGCTGCATCATCCAGGCATGAACCACCGGGTAGAAATCACAGAAGGC

ATATTGGCGGACGAATGTGCGGCGCTGTTGTGTCGTTTTTTTCGCATGCCCAGGCGGGTCTT

TAACGCCCAGAAAAAAGCACAATCCTCTACTGACGGCTCTTCTGGATCTGAAACACCTGGCA

CAAGCGAGAGCGCCACCCCTGAGAGCTCTGGCCTGAAAATCAAGAAGGGCAGCTCCAAGCAG

AGCAGCAGCGAGCTGGTGGATAGCGACATCCTGAAAGACAGCTTCGACCTGGCCTCCGAGCT

GAAAGGCGAAAAGCTGATGCTGTACAGGGACCCCAGCGGCAATGTGTTCCCCAGCGACAAAT

GGATGGCCGCTGGCGTGTTCTTCGGAAAGCTGGAACGCATCCTGATCAGCAAGCTGACCAAC

CAGTACTCCATCAGCACCATCGAGGACGACAGCAGCAAGCAGTCTATG*AAAAGGCCGGCGGC*

*CACGAAAAAGGCCGGCCAGGCAAAAAAGAAAAAGGGATCC*TACCCATACGATGTTCCAGATT

ACGCTTATCCCTACGACGTGCCTGATTATGCATACCCATATGATGTCCCCGACTATGCCTAA
(SEQ ID NO: 112)

MAPKKKRKVGIHGVPAAATRSFILKIEPNEEVKKGLWKTHEVLNHGIAYYMNILKLIRQEAI

YEHHEQDPKNPKKVSKAEIQAELWDFVLKMQKCNSFTHEVDKDEVFNILRELYEELVPSSVE

KKGEANQLSNKFLYPLVDPNSQSGKGTASSGRKPRWYNLKIAGDPSWEEEKKKWEEDKKKDP

LAKILGKLAEYGLIPLFIPYTDSNEPIVKEIKWMEKSRNQSVRRLDKDMFIQALERFLSWES

WNLKVKEEYEKVEKEYKTLEERIKEDIQALKALEQYEKERQEQLLRDTLNTNEYRLSKRGLR

GWREIIQKWLKMDENEPSEKYLEVFKDYQRKHPREAGDYSVYEFLSKKENHFIWRNHPEYPY

LYATFCEIDKKKKDAKQQATFTLADPINHPLWVRFEERSGSNLNKYRILTEQLHTEKLKKKL

TVQLDRLIYPTESGGWEEKGKVDIVLLPSRQFYNQIFLDIEEKGKHAFTYKDESIKFPLKGT

LGGARVQFDRDHLRRYPHKVESGNVGRIYFNMTVNIEPTESPVSKSLKIHRDDFPKVVNFKP

KELTEWIKDSKGKKLKSGIESLEIGLRVMSIDLGQRQAAAASIFEVVDQKPDIEGKLFFPIK

GTELYAVHRASFNIKLPGETLVKSREVLRKAREDNLKLMNQKLNFLRNVLHFQQFEDITERE

KRVTKWISRQENSDVPLVYQDELIQIRELMYKPYKDWVAFLKQLHKRLEVEIGKEVKHWRKS

LSDGRKGLYGISLKNIDEIDRTRKFLLRWSLRPTEPGEVRRLEPGQRFAIDQLNHLNALKED

RLKKMANTIIMHALGYCYDVRKKKWQAKNPACQIILFEDLSNYNPYEERSRFENSKLMKWSR

REIPRQVALQGEIYGLQVGEVGAQFSSRGHAKTGSPGIRCSVVTKEKLQDNRFFKNLQREGR

-continued

```
LTLDKIAVLKEGDLYPDKGGEKFISLSKDRKCVTTHADINAAQNLQKRFWTRTHGFYKVYCK

AYQVDGQTVYIPESKDQKQKIIEEFGEGYFILKDGVYEWVNAGKGGSGGSSEVEFSHEYWMR

HALTLAKRARDEREVPVGAVLVLNNRVIGEGWNRAIGLHDPTAHAEIMALRQGGLVMQNYRL

YDATLYVTFEPCVMCAGAMIHSRIGRVVFGVRNAKTGAAGSLMDVLHHPGMNHRVEITEGIL

ADECAALLCRFFRMPRRVFNAQKKAQSSTDGSSGSETPGTSESATPESSGLKIKKGSSKQSS

SELVDSDILKDSFDLASELKGEKLMLYRDPSGNVFPSDKWMAAGVFFGKLERILISKLTNQY

SISTIEDDSSKQSMKRPAATKKAGQAKKKKGSYPYDVPDYAYPYDVPDYAYPYDVPDYA
(SEQ ID NO: 113)
```

For the sequences above, the Kozak sequence is bolded and underlined; marks the N-terminal nuclear localization signal (NLS); lower case characters denote the GGGSGGS linker (SEQ ID NO: 114); _ _ _ _, marks the sequence encoding ABE8, unmodified sequence encodes BhCas12b; double underling denotes the Xten20 linker; single underlining denotes the C-terminal NLS;

GGATCC denotes the GS linker; and italicized characters represent the coding sequence of the 3× hemagglutinin (HA) tag.

Guide Polynucleotides

In an embodiment, the guide polynucleotide is a guide RNA. An RNA/Cas complex can assist in "guiding" Cas protein to a target DNA. Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gRNA") can be engineered so as to incorporate aspects of both the crRNA and tracrRNA into a single RNA species. See, e.g., Jinek M. et al., Science 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see e.g., "Complete genome sequence of an M1 strain of *Streptococcus pyogenes*." Ferretti, J. J. et al., Natl. Acad. Sci. U.S.A. 98:4658-4663 (2001); "CRISPR RNA maturation by trans-encoded small RNA and host factor RNase III." Deltcheva E. et al., Nature 471:602-607(2011); and "Programmable dual-RNA-guided DNA endonuclease in adaptive bacterial immunity." Jinek M. et al, Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In some embodiments, the guide polynucleotide is at least one single guide RNA ("sgRNA" or "gRNA"). In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

The polynucleotide programmable nucleotide binding domain (e.g., a CRISPR-derived domain) of the base editors disclosed herein can recognize a target polynucleotide sequence by associating with a guide polynucleotide. A guide polynucleotide (e.g., gRNA) is typically single-stranded and can be programmed to site-specifically bind (i.e., via complementary base pairing) to a target sequence of a polynucleotide, thereby directing a base editor that is in conjunction with the guide nucleic acid to the target sequence. A guide polynucleotide can be DNA. A guide polynucleotide can be RNA. In some embodiments, the guide polynucleotide comprises natural nucleotides (e.g., adenosine). In some embodiments, the guide polynucleotide comprises non-natural (or unnatural) nucleotides (e.g., peptide nucleic acid or nucleotide analogs). In some embodiments, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length.

In some embodiments, a guide polynucleotide comprises two or more individual polynucleotides, which can interact with one another via for example complementary base pairing (e.g., a dual guide polynucleotide). For example, a guide polynucleotide can comprise a CRISPR RNA (crRNA) and a trans-activating CRISPR RNA (tracrRNA). For example, a guide polynucleotide can comprise one or more trans-activating CRISPR RNA (tracrRNA).

In type II CRISPR systems, targeting of a nucleic acid by a CRISPR protein (e.g., Cas9) typically requires complementary base pairing between a first RNA molecule (crRNA) comprising a sequence that recognizes the target sequence and a second RNA molecule (trRNA) comprising repeat sequences which forms a scaffold region that stabilizes the guide RNA-CRISPR protein complex. Such dual guide RNA systems can be employed as a guide polynucleotide to direct the base editors disclosed herein to a target polynucleotide sequence.

In some embodiments, the base editor provided herein utilizes a single guide polynucleotide (e.g., gRNA). In some embodiments, the base editor provided herein utilizes a dual guide polynucleotide (e.g., dual gRNAs). In some embodiments, the base editor provided herein utilizes one or more guide polynucleotide (e.g., multiple gRNA). In some embodiments, a single guide polynucleotide is utilized for different base editors described herein. For example, a single guide polynucleotide can be utilized for a cytidine base editor and an adenosine base editor.

In other embodiments, a guide polynucleotide can comprise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide polynucleotide within a polynucleotide programmable nucleotide binding domain component of a base editor. In some embodiments, the polynucleotide targeting segment of the guide polynucleotide recognizes and binds to a DNA polynucleotide, thereby facilitating the editing of a base in DNA. In other embodiments, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/section of a complex such that a segment can comprise regions of more than one molecule. For example, where a guide polynucleotide comprises multiple nucleic acid molecules, the protein-binding segment of can include all or a portion of multiple separate molecules that are for instance hybridized along a region of complementarity. In some embodiments, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

A guide RNA or a guide polynucleotide can comprise two or more RNAs, e.g., CRISPR RNA (crRNA) and transactivating crRNA (tracrRNA). A guide RNA or a guide polynucleotide can sometimes comprise a single-chain RNA, or single guide RNA (sgRNA) formed by fusion of a portion (e.g., a functional portion) of crRNA and tracrRNA. A guide RNA or a guide polynucleotide can also be a dual RNA comprising a crRNA and a tracrRNA. Furthermore, a crRNA can hybridize with a target DNA.

As discussed above, a guide RNA or a guide polynucleotide can be an expression product. For example, a DNA that encodes a guide RNA can be a vector comprising a sequence coding for the guide RNA. A guide RNA or a guide polynucleotide can be transferred into a cell by transfecting the cell with an isolated guide RNA or plasmid DNA comprising a sequence coding for the guide RNA and a promoter. A guide RNA or a guide polynucleotide can also be transferred into a cell in other way, such as using virus-mediated gene delivery.

A guide RNA or a guide polynucleotide can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA or a guide polynucleotide can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA or a guide polynucleotide can be complementary to sequence at a target site in a chromosomal sequence such that the first region of the guide RNA can base pair with the target site. In some embodiments, a first region of a guide RNA can comprise from or from about 10 nucleotides to 25 nucleotides (i.e., from 10 nucleotides to nucleotides; or from about 10 nucleotides to about 25 nucleotides; or from 10 nucleotides to about 25 nucleotides; or from about 10 nucleotides to 25 nucleotides) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. Sometimes, a first region of a guide RNA can be or can be about 19, 20, or 21 nucleotides in length.

A guide RNA or a guide polynucleotide can also comprise a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA or a guide polynucleotide can also comprise a third region at the 3' end that can be essentially single-stranded. For example, a third region is sometimes not complementarity to any chromosomal sequence in a cell of interest and is sometimes not complementarity to the rest of a guide RNA. Further, the length of a third region can vary. A third region can be more than or more than about 4 nucleotides in length. For example, the length of a third region can range from or from about 5 to 60 nucleotides in length.

A guide RNA or a guide polynucleotide can target any exon or intron of a gene target. In some embodiments, a guide can target exon 1 or 2 of a gene; in other embodiments, a guide can target exon 3 or 4 of a gene. A composition can comprise multiple guide RNAs that all target the same exon or in some embodiments, multiple guide RNAs that can target different exons. An exon and an intron of a gene can be targeted.

A guide RNA or a guide polynucleotide can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30, or anywhere between 1-100 nucleotides in length. A target nucleic acid can be at most or at most about 5, 10, 15, 16, 17, 18, 19, 20, 21, 22, 23, 24, 25, 30, 40, 50, or anywhere between 1-100 nucleotides in length. A target nucleic acid sequence can be or can be about 20 bases immediately 5' of the first nucleotide of the PAM. A guide RNA can target a nucleic acid sequence. A target nucleic acid can be at least or at least about 1-10, 1-20, 1-30, 1-40, 1-50, 1-60, 1-70, 1-80, 1-90, or 1-100 nucleotides.

A guide polynucleotide, for example, a guide RNA, can refer to a nucleic acid that can hybridize to another nucleic acid, for example, the target nucleic acid or protospacer in a genome of a cell. A guide polynucleotide can be RNA. A guide polynucleotide can be DNA. The guide polynucleotide can be programmed or designed to bind to a sequence of nucleic acid site-specifically. A guide polynucleotide can comprise a polynucleotide chain and can be called a single guide polynucleotide. A guide polynucleotide can comprise two polynucleotide chains and can be called a double guide polynucleotide. A guide RNA can be introduced into a cell or embryo as an RNA molecule. For example, a RNA molecule can be transcribed in vitro and/or can be chemically synthesized. An RNA can be transcribed from a synthetic DNA molecule, e.g., a gBlocks® gene fragment. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III). Plasmid vectors that can be used to express guide RNA include, but are not limited to, px330 vectors and px333 vectors. In some embodiments, a plasmid vector (e.g., px333 vector) can comprise at least two guide RNA-encoding DNA sequences.

Methods for selecting, designing, and validating guide polynucleotides, e.g., guide RNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on ssDNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g., NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g., crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a guide RNA for use with Cas9s may be identified using a DNA sequence searching algorithm. gRNA design may be carried out using custom gRNA design software based on the public tool cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g., a target gene may be obtained and repeat elements may be screened using publicly available tools, for example, the RepeatMasker program. RepeatMasker searches input DNA sequences for repeated elements and regions of low complexity. The output is a detailed annotation of the repeats present in a given query sequence.

Following identification, first regions of guide RNAs, e.g., crRNAs, may be ranked into tiers based on their distance to the target site, their orthogonality and presence of 5' nucleotides for close matches with relevant PAM sequences (for example, a 5' G based on identification of close matches in the human genome containing a relevant PAM e.g., NGG PAM for *S. pyogenes*, NNGRRT or NNGRRV PAM for *S. aureus*). As used herein, orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

In some embodiments, a reporter system may be used for detecting base-editing activity and testing candidate guide polynucleotides. In some embodiments, a reporter system may comprise a reporter gene based assay where base editing activity leads to expression of the reporter gene. For example, a reporter system may include a reporter gene comprising a deactivated start codon, e.g., a mutation on the template strand from 3'-TAC-5' to 3'-CAC-5'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which residue(s) with respect to the target DNA sequence the respective deaminase will target. sgRNAs that target non-template strand can also be tested in order to assess off-target effects of a specific base editing protein, e.g., a Cas9 deaminase fusion protein. In some embodiments, such gRNAs can be designed such that the mutated start codon will not be base-paired with the gRNA. The guide polynucleotides can comprise standard ribonucleotides, modified ribonucleotides (e.g., pseudouridine), ribonucleotide isomers, and/or ribonucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or suitable fluorescent dye), a detection tag (e.g., biotin, digoxigenin, and the like), quantum dots, or gold particles.

The guide polynucleotides can be synthesized chemically, synthesized enzymatically, or a combination thereof. For example, the guide RNA can be synthesized using standard phosphoramidite-based solid-phase synthesis methods. Alternatively, the guide RNA can be synthesized in vitro by operably linking DNA encoding the guide RNA to a promoter control sequence that is recognized by a phage RNA polymerase. Examples of suitable phage promoter sequences include T7, T3, SP6 promoter sequences, or variations thereof. In embodiments in which the guide RNA comprises two separate molecules (e.g., crRNA and tracrRNA), the crRNA can be chemically synthesized and the tracrRNA can be enzymatically synthesized.

In some embodiments, a base editor system may comprise multiple guide polynucleotides, e.g., gRNAs. For example, the gRNAs may target to one or more target loci (e.g., at least 1 gRNA, at least 2 gRNA, at least 5 gRNA, at least 10 gRNA, at least 20 gRNA, at least 30 g RNA, at least 50 gRNA) comprised in a base editor system. The multiple gRNA sequences can be tandemly arranged and are preferably separated by a direct repeat.

A DNA sequence encoding a guide RNA or a guide polynucleotide can also be part of a vector. Further, a vector can comprise additional expression control sequences (e.g., enhancer sequences, Kozak sequences, polyadenylation sequences, transcriptional termination sequences, etc.), selectable marker sequences (e.g., GFP or antibiotic resistance genes such as puromycin), origins of replication, and the like. A DNA molecule encoding a guide RNA can also be linear. A DNA molecule encoding a guide RNA or a guide polynucleotide can also be circular.

In some embodiments, one or more components of a base editor system may be encoded by DNA sequences. Such DNA sequences may be introduced into an expression system, e.g., a cell, together or separately. For example, DNA sequences encoding a polynucleotide programmable nucleotide binding domain and a guide RNA may be introduced into a cell, each DNA sequence can be part of a separate molecule (e.g., one vector containing the polynucleotide programmable nucleotide binding domain coding sequence and a second vector containing the guide RNA coding sequence) or both can be part of a same molecule (e.g., one vector containing coding (and regulatory) sequence for both the polynucleotide programmable nucleotide binding domain and the guide RNA).

A guide polynucleotide can comprise one or more modifications to provide a nucleic acid with a new or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some embodiments, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some embodiments, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by 5'adenylate, 5' guanosine-triphosphate cap, 5'N7-Methylguanosine-triphosphate cap, 5'triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some embodiments, a modification is permanent. In other embodiments, a modification is transient. In some embodiments, multiple modifications are made to a gRNA or a guide polynucleotide. A gRNA or a guide polynucleotide modification can alter physiochemical properties of a nucleotide, such as their conformation, polarity, hydrophobicity, chemical reactivity, base-pairing interactions, or any combination thereof.

The PAM sequence can be any PAM sequence known in the art. Suitable PAM sequences include, but are not limited to, NGG, NGA, NGC, NGN, NGT, NGCG, NGAG, NGAN, NGNG, NGCN, NGCG, NGTN, NNGRRT, NNNRRT, NNGRR(N), TTTV, TYCV, TYCV, TATV, NNNNGATT, NNAGAAW, or NAAAAC. Y is a pyrimidine; N is any nucleotide base; W is A or T.

A modification can also be a phosphorothioate substitute. In some embodiments, a natural phosphodiester bond can be susceptible to rapid degradation by cellular nucleases and; a modification of internucleotide linkage using phosphorothioate (PS) bond substitutes can be more stable towards hydrolysis by cellular degradation. A modification can increase stability in a gRNA or a guide polynucleotide. A modification can also enhance biological activity. In some embodiments, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or ''-end of a gRNA which can inhibit exonuclease degradation. In some embodiments, phosphorothioate bonds can be added throughout an entire gRNA to reduce attack by endonucleases.

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The PAM sequence is essential for target binding, but the exact sequence depends on a type of Cas protein.

Figure 2A:
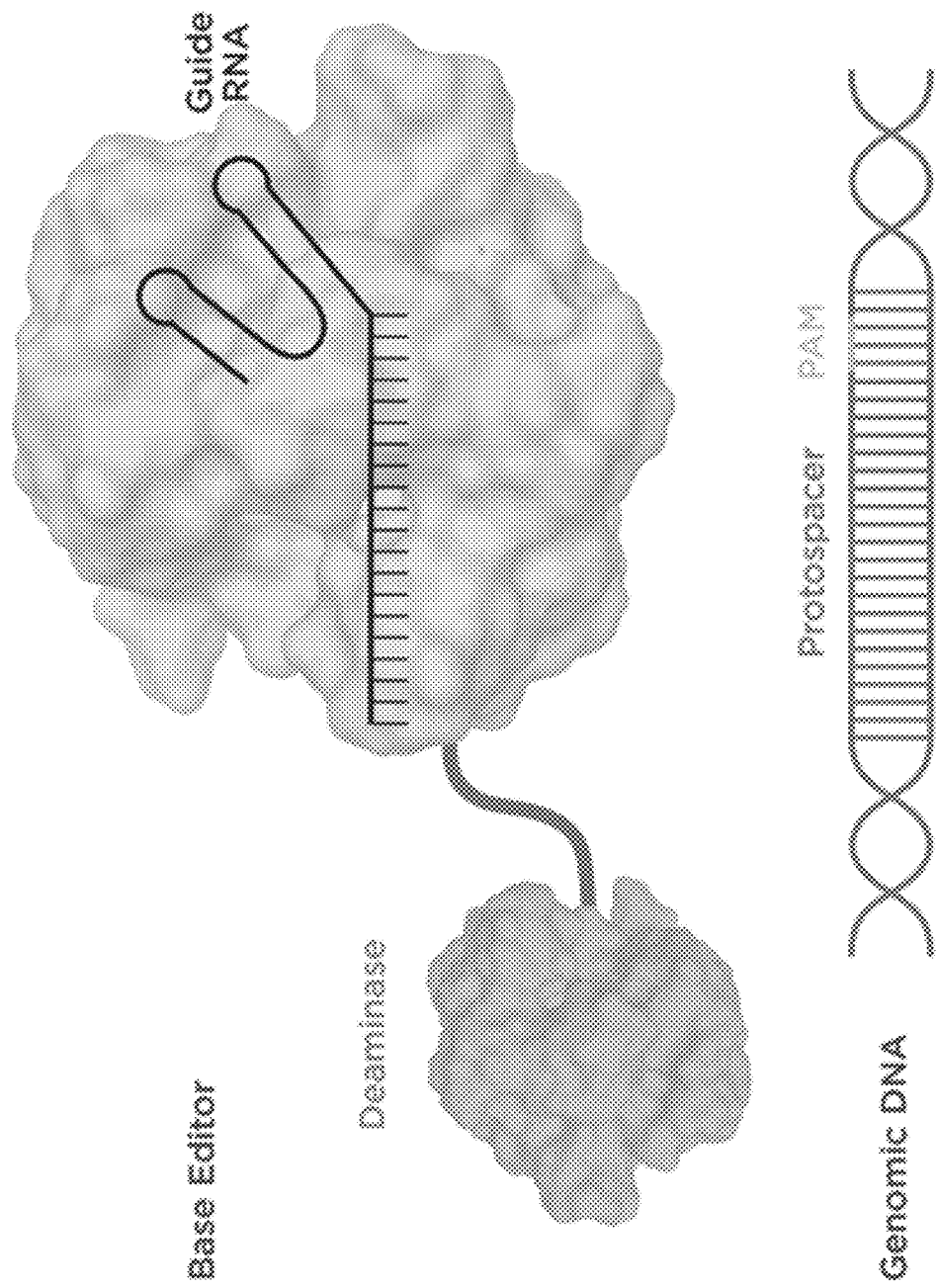
FIGS. 2A-2C depict the selection of adenine deaminase (TadA) through directed evolution.

A base editor provided herein can comprise a CRISPR protein-derived domain that is capable of binding a nucleotide sequence that contains a canonical or non-canonical protospacer adjacent motif (PAM) sequence (FIG. 2A). A PAM site is a nucleotide sequence in proximity to a target polynucleotide sequence. Some aspects of the disclosure provide for base editors comprising all or a portion of CRISPR proteins that have different PAM specificities.

For example, typically Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length. Several PAM variants are described in Table 2 below.

TABLE 2

Cas9 proteins and corresponding PAM sequences

| Variant | PAM |
| --- | --- |
| spCas9 | NGG |
| spCas9-VRQR | NGA |
| spCas9-VRER | NGCG |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| spCas9-MQKFRAER | NGC |
| Cpf1 | 5' (TTTV) |
| SpyMac | 5'-NAA-3' |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the PAM is NGT. In some embodiments, the NGT PAM is recognized by a Cas9 variant. In some embodiments, the NGT PAM variant is generated through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Tables 3A and 3B below.

TABLE 3A

NGT PAM Variant Mutations at residues 1219, 1335, 1337, 1218

| Variant | E1219V | R1335Q | T1337 | G1218 |
| --- | --- | --- | --- | --- |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 3B

NGT PAM Variant Mutations at residues 1135, 1136, 1218, 1219, and 1335

| Variant | D1135L | S1136R | G1218S | E1219V | R1335Q |
| --- | --- | --- | --- | --- | --- |
| 27 | G | | | | |
| 28 | V | | | | |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Tables 2 and 3. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 4 below.

TABLE 4

NGT PAM Variant Mutations at residues 1219, 1335, 1337, and 1218

| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, base editors with specificity for NGT PAM may be generated as provided in Table 5 below.

TABLE 5

NGT PAM variants

| | NGTN variant | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

In some embodiments the NGTN variant is variant 1. In some embodiments, the NGTN variant is variant 2. In some embodiments, the NGTN variant is variant 3. In some embodiments, the NGTN variant is variant 4. In some embodiments, the NGTN variant is variant 5. In some embodiments, the NGTN variant is variant 6.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1134X, a R1335X, and a T1336X mutation, or a corresponding mutation in any of the amino acid sequences provided herein, wherein X is any amino acid. In some embodiments, the SpCas9 domain comprises one or more of a D1134E, R1335Q, and T1336R mutation, or a corresponding mutation in any of the amino acid sequences provided herein. In some embodiments, the SpCas9 domain comprises a D1134E, a R1335Q, and a T1336R mutation, or corresponding mutations in any of the amino acid sequences provided herein. In some embodiments, the SpCas9 domain comprises one or more of a D1134X, a R1335X, and a T1336X mutation, or a corresponding mutation in any of the amino acid sequences provided herein, wherein X is any amino acid. In some embodiments, the SpCas9 domain comprises one or more of a D1134V, a R1335Q, and a T1336R mutation, or a corresponding mutation in any of the amino acid sequences provided herein. In some embodiments, the SpCas9 domain comprises a D1134V, a R1335Q, and a T1336R mutation, or corresponding mutations in any of the amino acid sequences provided herein. In some embodiments, the SpCas9 domain comprises one or more of a D1134X, a G1217X, a R1335X, and a T1336X mutation, or a corresponding mutation in any of the amino acid sequences provided herein, wherein X is any amino acid. In some embodiments, the SpCas9 domain comprises one or more of a D1134V, a G1217R, a R1335Q, and a T1336R mutation, or a corresponding mutation in any of the amino acid sequences provided herein. In some embodiments, the SpCas9 domain comprises a D1134V, a G1217R, a R1335Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kb coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of *S. thermophilus* (5'-NNAGAA for CRISPR1 and 5'-NGGNG for CRISPR3) and *Neisseria meningiditis* (5'-NNNNGATT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

The amino acid sequence of an exemplary PAM-binding SpCas9 is as follows:

MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD (SEQ ID NO: 1)

The amino acid sequence of an exemplary PAM-binding SpCas9n is as follows:

MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD (SEQ ID NO: 32)

The amino acid sequence of an exemplary PAM-binding SpEQR Cas9 is as follows:

MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESVLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP

-continued

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFESPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKQYRSTKEVLDATLIHQ

SITGLYETRIDLSQLGGD (SEQ ID NO: 115)

In the above sequence, residues E1134, Q1334, and R1336, which can be mutated from D1134, R1335, and T1336 to yield a SpEQR Cas9, are underlined and in bold.

The amino acid sequence of an exemplary PAM-binding SpVQR Cas9 is as follows:

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFVSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKQYRSTKEVLDATLIHQ

SITGLYETRIDLSQLGGD (SEQ ID NO: 116)

In the above sequence, residues V1134, Q1334, and R1336, which can be mutated from D1134, R1335, and T1336 to yield a SpVQR Cas9, are underlined and in bold.

The amino acid sequence of an exemplary PAM-binding SpVRER Cas9 is as follows:

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

-continued

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGF<u>V</u>SPTVAYSVLVVAKVE

KGKSKKLKSVKELLGITIMERSSFEKNPIDFLEAKGYKEVKKDLIIKLPK

YSLFELENGRKRMLASA<u>R</u>ELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRK<u>EYR</u>STKEVLDATLIHQ

SITGLYETRIDLSQLGGD (SEQ ID NO: 117).

In the above sequence, residues V1134, R1217, Q1334, and R1336, which can be mutated from D1134, G1217, R1335, and T1336 to yield a SpVRER Cas9, are underlined and in bold.

In some embodiments, engineered SpCas9 variants are capable of recognizing protospacer adjacent motif (PAM) sequences flanked by a 3' H (non-G PAM) (see Tables 1A-1D; FIG. 62). In some embodiments, the SpCas9 variants recognize NRNH PAMs (where R is A or G and H is A, C or T). In some embodiments, the non-G PAM is NRRH, NRTH, or NRCH (see e.g., Miller, S. M., et al. Continuous evolution of SpCas9 variants compatible with non-G PAMs, Nat. Biotechnol. (2020), the contents of which is incorporated herein by reference in its entirety).

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a SpyMacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMacCas9 domain, the SpCas9d domain, or the SpCas9n domain can bind to a nucleic acid sequence having a NAA PAM sequence.

The sequence of an exemplary Cas9 A homolog of Spy Cas9 in Streptococcus macacae with native 5'-NAAN-3' PAM specificity is known in the art and described, for example, by Jakimo et al., (www.biorxiv.org/content/biorxiv/early/2018/09/27/429654.full.pdf), and is provided below.

SpyMacCas9
MDKKYSIGLDIGTNSVGWAVITDDYKVPSKKFKVLGNTDRHSIKKNLIGA

LLFGSGETAEATRLKRTARRRYTRRKNRICYLQEIFSNEMAKVDDSFFHR

LEESFLVEEDKKHERHPIFGNIVDEVAYHEKYPTIYHLRKKLADSTDKAD

LRLIYLALAHMIKFRGHFLIEGDLNPDNSDVDKLFIQLVQIYNQLFEENP

INASRVDAKAILSARLSKSRRLENLIAQLPGEKRNGLFGNLIALSLGLTP

NFKSNFDLAEDAKLQLSKDTYDDDLDNLLAQIGDQYADLFLAAKNLSDAI

LLSDILRVNSEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

-continued
NLPNEKVLPKHSLLYEYFTVYNELTKVKYVTEGMRKPAFLSGEQKKAIVD

LLFKTNRKVTVKQLKEDYFKKIECFDSVEISGVEDRFNASLGAYHDLLKI

IKDKDFLDNEENEDILEDIVLTLTLFEDRGMIEERLKTYAHLFDDKVMKQ

LKRRRYTGWGRLSRKLINGIRDKQSGKTILDFLKSDGFANRNFMQLIHDD

SLTFKEDIQKAQVSGQGHSLHEQIANLAGSPAIKKGILQTVKIVDELVKV

MGHKPENIVIEMARENQTTQKGQKNSRERMKRIEEGIKELGSQILKEHPV

ENTQLQNEKLYLYYLQNGRDMYVDQELDINRLSDYDVDHIVPQSFIKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEIQ

TVGQNGGLFDDNPKSPLEVTPSKLVPLKKELNPKKYGGYQKPTTAYPVLL

ITDTKQLIP1SVMNKKQFEQNPVKFLRDRGYQQVGKNDFIKLPKYTLVDI

GDGIKRLWASSKEIHKGNQLVVSKKSQILLYHAHHLDSDLSNDYLQNHNQ

QFDVLFNEIISFSKKCKLGKEHIQKIENVYSNKKNSASIEELAESFIKLL

GFTQLGATSPFNFLGVKLNQKQYKGKKDYILPCTEGTLIRQSITGLYETR

VDLSKIGED (SEQ ID NO: 118).

In some embodiments, a variant Cas9 protein harbors, H840A, P475A, W476A, N477A, D1125A, Wi126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

Cas9 Domains with Reduced PAM Exclusivity

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" Nature 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild-type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

In some embodiments, the modified Cas9 is a high fidelity Cas9 enzyme. In some embodiments, the high fidelity Cas9 enzyme is SpCas9(K855A), eSpCas9(1.1), SpCas9-HF1, or hyper accurate Cas9 variant (HypaCas9). The modified Cas9 eSpCas9(1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9.

An exemplary high fidelity Cas9 is provided below. High Fidelity Cas9 domain mutations relative to Cas9 are shown in bold and underlined.

DKKYSIGLAAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

```
                            -continued
LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD (SEQ ID NO: 119)
```

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFESPKKKRKV (SEQ ID NO: 120), KRTADGSEFESPKKKRKV (SEQ ID NO: 69), KRPAATKKAGQAKKKK (SEQ ID NO: 70), KKTELQTTNAENKTKKL (SEQ ID NO: 71), KRGINDRNFWRGENGRKTR (SEQ ID NO: 72), RKSGKIAAIVVKRPRKPKKKRKV (SEQ ID NO: 121), or MDSLLMNRRKFLYQFKNVRWAKGRRETYLC (SEQ ID NO: 75).

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 122), is the prototype of the ubiquitous bipartite signal: two clusters of basic amino acids, separated by a spacer of about 10 amino acids. The sequence of an exemplary bipartite NLS follows: PKKKRKVEGADKRTADGSEFESPKKKRKV (SEQ ID NO: 120)

In some embodiments, the fusion proteins of the disclosure do not comprise a linker sequence. In some embodiments, linker sequences between one or more of the domains or proteins are present. In some embodiments, the general architecture of exemplary Cas9 fusion proteins with an adenosine deaminase or cytidine deaminase and a Cas9 domain comprises any one of the following structures, where NLS is a nuclear localization sequence (e.g., any NLS provided herein), $NH_2$ is the N-terminus of the fusion protein, and COOH is the C-terminus of the fusion protein:

$NH_2$-NLS-[adenosine deaminase]-[Cas9 domain]-COOH;
$NH_2$-NLS [Cas9 domain]-[adenosine deaminase]-COOH;
$NH_2$-[adenosine deaminase]-[Cas9 domain]-NLS—COOH;
$NH_2$-[Cas9 domain]-[adenosine deaminase]-NLS—COOH;
$NH_2$-NLS-[cytidine deaminase]-[Cas9 domain]-COOH;
$NH_2$-NLS [Cas9 domain]-[cytidine deaminase]-COOH;
$NH_2$-[cytidine deaminase]-[Cas9 domain]-NLS-COOH; or
$NH_2$-[Cas9 domain]-[cytidine deaminase]-NLS-COOH.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the amino-terminus, about or more than about 1, 2, 3, 4, 5, 6, 7, 8, 9, 10 NLSs at or near the carboxy-terminus, or any combination of these (e.g., one or more NLS at the amino-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

Nucleobase Editing Domain

Described herein are base editors comprising a fusion protein that includes a polynucleotide programmable nucleotide binding domain and a nucleobase editing domain (e.g., a deaminase domain). The base editor can be programmed to edit one or more bases in a target polynucleotide sequence by interacting with a guide polynucleotide capable of recognizing the target sequence. Once the target sequence has been recognized, the base editor is anchored on the polynucleotide where editing is to occur and the deaminase domain components of the base editor can then edit a target base.

In some embodiments, the nucleobase editing domain includes a deaminase domain. As particularly described herein, the deaminase domain includes a cytosine deaminase or an adenosine deaminase. In some embodiments, the terms "cytosine deaminase" and "cytidine deaminase" can be used interchangeably. In some embodiments, the terms "adenine deaminase" and "adenosine deaminase" can be used interchangeably. Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A to G Editing

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein can comprise a Cas9 domain that has reduced nuclease activity. In some embodiments, the fusion proteins provided herein can have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, an A-to-G base editor further comprises an inhibitor of inosine base excision repair, for example, a uracil glycosylase inhibitor (UGI) domain or a catalytically inactive inosine specific nuclease. Without wishing to be bound by any particular theory, the UGI domain or catalytically inactive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor comprising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor comprises all or a portion of adenosine deaminase acting on RNA (ADAR, e.g., ADAR1 or ADAR2). In another embodiment, an adenosine deaminase incorporated into a base editor comprises all or a portion of adenosine deaminase acting on tRNA (ADAT). A base editor comprising an adenosine deaminase domain can also be capable of deaminating an A nucleobase of a DNA polynucleotide. In an embodiment an adenosine deaminase domain of a base editor comprises all or a portion of an ADAT comprising one or more mutations which permit the ADAT to deaminate a target A in DNA. For example, the base editor can comprise all or a portion of an ADAT from $Escherichia\ coli$ (EcTadA) comprising one or more of the following mutations: D108N, A106V, D147Y, E155V, L84F, H123Y, I156F, or a corresponding mutation in another adenosine deaminase.

The adenosine deaminase can be derived from any suitable organism (e.g., $E.\ coli$). In some embodiments, the adenine deaminase is a naturally-occurring adenosine deaminase that includes one or more mutations corresponding to any of the mutations provided herein (e.g., mutations in ecTadA). The corresponding residue in any homologous protein can be identified by e.g., sequence alignment and determination of homologous residues. The mutations in any naturally-occurring adenosine deaminase (e.g., having homology to ecTadA) that corresponds to any of the mutations described herein (e.g., any of the mutations identified in ecTadA) can be generated accordingly.

C to T Editing

In some embodiments, a base editor disclosed herein comprises a fusion protein comprising cytidine deaminase capable of deaminating a target cytidine (C) base of a polynucleotide to produce uridine (U), which has the base pairing properties of thymine. In some embodiments, for example where the polynucleotide is double-stranded (e.g., DNA), the uridine base can then be substituted with a thymidine base (e.g., by cellular repair machinery) to give rise to a C:G to a T:A transition. In other embodiments, deamination of a C to U in a nucleic acid by a base editor cannot be accompanied by substitution of the U to a T.

The deamination of a target C in a polynucleotide to give rise to a U is a non-limiting example of a type of base editing that can be executed by a base editor described herein. In another example, a base editor comprising a cytidine deaminase domain can mediate conversion of a cytosine (C) base to a guanine (G) base. For example, a U of a polynucleotide produced by deamination of a cytidine by a cytidine deaminase domain of a base editor can be excised from the polynucleotide by a base excision repair mechanism (e.g., by a uracil DNA glycosylase (UDG) domain), producing an abasic site. The nucleobase opposite the abasic site can then be substituted (e.g., by base repair machinery) with another base, such as a C, by for example a translesion polymerase. Although it is typical for a nucleobase opposite an abasic site to be replaced with a C, other substitutions (e.g., A, G or T) can also occur.

Accordingly, in some embodiments a base editor described herein comprises a deamination domain (e.g., cytidine deaminase domain) capable of deaminating a target C to a U in a polynucleotide. Further, as described below, the base editor can comprise additional domains which facilitate conversion of the U resulting from deamination to, in some embodiments, a T or a G. For example, a base editor comprising a cytidine deaminase domain can further comprise a uracil glycosylase inhibitor (UGI) domain to mediate substitution of a U by a T, completing a C-to-T base editing event. In another example, a base editor can incorporate a translesion polymerase to improve the efficiency of C-to-G base editing, since a translesion polymerase can facilitate incorporation of a C opposite an abasic site (i.e., resulting in incorporation of a G at the abasic site, completing the C-to-G base editing event).

A base editor comprising a cytidine deaminase as a domain can deaminate a target C in any polynucleotide, including DNA, RNA and DNA-RNA hybrids. Typically, a cytidine deaminase catalyzes a C nucleobase that is positioned in the context of a single-stranded portion of a polynucleotide. In some embodiments, the entire polynucleotide comprising a target C can be single-stranded. For example, a cytidine deaminase incorporated into the base editor can deaminate a target C in a single-stranded RNA polynucleotide. In other embodiments, a base editor comprising a cytidine deaminase domain can act on a double-stranded polynucleotide, but the target C can be positioned in a portion of the polynucleotide which at the time of the deamination reaction is in a single-stranded state. For example, in embodiments where the NAGPB domain comprises a Cas9 domain, several nucleotides can be left unpaired during formation of the Cas9-gRNA-target DNA complex, resulting in formation of a Cas9 "R-loop complex". These unpaired nucleotides can form a bubble of single-stranded DNA that can serve as a substrate for a single-strand specific nucleotide deaminase enzyme (e.g., cytidine deaminase).

In some embodiments, a cytidine deaminase of a base editor can comprise all or a portion of an apolipoprotein B mRNA editing complex (APOBEC) family deaminase. APOBEC is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. In some embodiments, a deaminase incorporated into a base editor comprises all or a portion of an APOBEC1 deaminase. In some embodiments, a deaminase incorporated into a base editor comprises all or a portion of APOBEC2 deaminase. In some embodiments, a deaminase incorporated into a base editor comprises all or a portion of is an APOBEC3 deaminase. In some embodiments, a deaminase incorporated into a base editor comprises all or a portion of an APOBEC3A deaminase. In some embodiments, a deaminase incorporated into a base editor comprises all or a portion of APOBEC3B deaminase. In some embodiments, a deaminase incorporated into a base editor comprises all or a portion of APOBEC3C deaminase. In some embodiments, a deaminase incorporated into a base editor comprises all or a portion of APOBEC3D deaminase. In some embodiments, a deaminase incorporated into a base editor comprises all or a portion of APOBEC3E deaminase. In some embodiments, a deaminase incorporated into a base editor comprises all or a portion of APOBEC3F deaminase. In some embodiments, a deaminase incorporated into a base editor comprises all or a portion of APOBEC3G deaminase. In some embodiments, a deaminase incorporated into a base editor comprises all or a portion of APOBEC3H deaminase. In some embodiments, a deaminase incorporated into a base editor comprises all or a portion of APOBEC4 deaminase. In some embodiments, a deaminase incorporated into a base editor comprises all or a portion of activation-induced deaminase (AID). In some embodiments a deaminase incorporated into a base editor comprises all or a portion of cytidine deaminase 1 (CDA1). It should be appreciated that a base editor can comprise a deaminase from any suitable organism (e.g., a human or a rat). In some embodiments, a deaminase domain of a base editor is from a human, chimpanzee, gorilla, monkey, cow, dog, rat, or mouse. In some embodiments, the deaminase domain of the base editor is derived from rat (e.g., rat APOBEC1). In some embodiments, the deaminase domain of the base editor is human APOBEC1. In some embodiments, the deaminase domain of the base editor is pmCDA1.

The amino acid and nucleic acid sequences of PmCDA1 are shown herein below.

```
>tr|A5H718|A5H718_PETMA Cytosine deaminase
OS = Petromyzon marinus OX = 7757 PE = 2
SV = 1 amino acid sequence:
MTDAEYVRIHEKLDIYTFKKQFFNNKKSVSHRCYVLFELKRRGERRACFW

GYAVNKPQSGTERGIHAEIFSIRKVEEYLRDNPGQFTINWYSSWSPCADC

AEKILEWYNQELRGNGHTLKIWACKLYYEKNARNQIGLWNLRDNGVGLNV

MVSEHYQCCRKIFIQSSHNQLNENRWLEKTLKRAEKRRSELSIMIQVKIL

HTTKSPAV (SEQ ID NO: 123)

Nucleic acid sequence: >EF094822.1
Petromyzon marinus isolate PmCDA.21 cytosine
deaminase mRNA, complete cds:
TGACACGACACAGCCGTGTATATGAGGAAGGGTAGCTGGATGGGGGGGG

GGGAATACGTTCAGAGAGGACATTAGCGAGCGTCTTGTTGGTGGCCTTGA

GTCTAGACACCTGCAGACATGACCGACGCTGAGTACGTGAGAATCCATGA

GAAGTTGGACATCTACACGTTTAAGAAACAGTTTTTCAACAACAAAAAAT

CCGTGTCGCATAGATGCTACGTTCTCTTTGAATTAAAACGACGGGGTGAA

CGTAGAGCGTGTTTTTGGGGCTATGCTGTGAATAAACCACAGAGCGGGAC

AGAACGTGGAATTCACGCCGAAATCTTTAGCATTAGAAAAGTCGAAGAAT

ACCTGCGCGACAACCCCGGACAATTCACGATAAATTGGTACTCATCCTGG

AGTCCTTGTGCAGATTGCGCTGAAAAGATCTTAGAATGGTATAACCAGGA

GCTGCGGGGAACGGCCACACTTTGAAAATCTGGGCTTGCAAACTCTATT

ACGAGAAAAATGCGAGGAATCAAATTGGGCTGTGGAACCTCAGAGATAAC

GGGGTTGGGTTGAATGTAATGGTAAGTGAACACTACCAATGTTGCAGGAA

AATATTCATCCAATCGTCGCACAATCAATTGAATGAGAATAGATGGCTTG

AGAAGACTTTGAAGCGAGCTGAAAAACGACGGAGCGAGTTGTCCATTATG

ATTCAGGTAAAAATACTCCACACCACTAAGAGTCCTGCTGTTTAAGAGGC

TATGCGGATGGTTTTC (SEQ ID NO: 124)
```

The amino acid and nucleic acid sequences of the coding sequence (CDS) of human activation-induced cytidine deaminase (AID) are shown below.

```
>tr|Q6QJ80|Q6QJ80_HUMAN Activation-induced
cytidine deaminase OS = Homo sapiens
OX = 9606 GN = AICDAPE = 2 SV = 1 amino acid
sequence:
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPNLSLRIFTARLYFCEDRKAEPEGLRRLHRAGVQIAIMTFKAPV
(SEQ ID NO: 125)
```

The amino acid and nucleic acid sequences of the coding sequence (CDS) of human activation-induced cytidine deaminase (AID) are shown below.

```
>tr|Q6QJ80|Q6QJ80_HUMAN Activation-induced cytidine deaminase OS = Homo sapiens
OX = 9606 GN = AICDA PE = 2 SV = 1 amino acid sequence:
MDSLLMNRRKFLYQFKNVRWAKGRRETYLCYVVKRRDSATSFSLDFGYLRNKNGCHVELLFLRYISDWDLDPGRCYRVTWFTS

WSPCYDCARHVADFLRGNPNLSLRIFTARLYFCEDRKAEPEGLRRLHRAGVQIAIMTFKAPV (SEQ ID NO: 125)

Nucleic acids equence: >NG_011588.1: 5001-15681 Homo sapiens activation induced
cytidine deaminase (AICDA), RefSeqGene (LRG17) on chromosome 12:
AGAGAACCATCATTAATTGAAGTGAGATTTTTCTGGCCTGAGACTTGCAGGGAGGCAAGAAGACACTCTGGACACCACTATGG ACAGGTAAAGAGGCAGTCTTCTCGTGGGTGATTGCACTGGCCTTCCTCTCAGAGCAAATCTGAGTAATGAGACTGGTAGCTAT CCCTTTCTCTCATGTAACTGTCTGACTGATAAGATCAGCTTGATCAATATGCATATATATTTTTTGATCTGTCTCCTTTTCTT CTATTCAGATCTTATACGCTGTCAGCCCAATTCTTTCTGTTTCAGACTTCTCTTGATTTCCCTCTTTTTCATGTGGCAAAAGA AGTAGTGCGTACAATGTACTGATTCGTCCTGAGATTTGTACCATGGTTGAAACTAATTTATGGTAATAATATTAACATAGCAA ATCTTTAGAGACTCAAATCATGAAAAGGTAATAGCAGTACTGTACTAAAAACGGTAGTGCTAATTTTCGTAATAATTTTGTAA ATATTCAACAGTAAAACAACTTGAAGACACACTTTCCTAGGGAGGCGTTACTGAAATAATTTAGCTATAGTAAGAAAATTTGT AATTTTAGAAATGCCAAGCATTCTAAATTAATTGCTTGAAAGTCACTATGATTGTGTCCATTATAAGGAGACAAATTCATTCA AGCAAGTTATTTAATGTTAAAGGCCCAATTGTTAGGCAGTTAATGGCACTTTTACTATTAACTAATCTTTCCATTTGTTCAGA CGTAGCTTAACTTACCTCTTAGGTGTGAATTTGGTTAAGGTCCTCATAATGTCTTTATGTGCAGTTTTTGATAGGTTATTGTC ATAGAACTTATTCTATTCCTACATTTATGATTACTATGGATGTATGAGAATAACACCTAATCCTTATACTTTACCTCAATTTA ACTCCTTTATAAAGAACTTACATTACAGAATAAAGATTTTTAAAAATATATTTTTTGTAGAGACAGGGTCTTAGCCCAGCC GAGGCTGGTCTCTAAGTCCTGGCCCAAGCGATCCTCCTGCCTGGGCCTCCTAAAGTGCTGGAATTATAGACATGAGCCATCAC ATCCAATATACAGAATAAAGATTTTTAATGGAGGATTTAATGTTCTTCAGAAAATTTTCTTGAGGTCAGACAATGTCAAATGT CTCCTCAGTTTACACTGAGATTTTGAAAACAAGTCTGAGCTATAGGTCCTTGTGAAGGGTCCATTGGAAATACTTGTTCAAAG TAAAATGGAAAGCAAAGGTAAAATCAGCAGTTGAAATTCAGAGAAAGACAGAAAAGGAGAAAAGATGAAATTCAACAGGACAG AAGGGAAATATATTATCATTAAGGAGGACAGTATCTGTAGAGCTCATTAGTGATGGCAAAATGACTTGGTCAGGATTATTTTT AACCCGCTTGTTTCTGGTTTGCACGGCTGGGGATGCAGCTAGGGTTCTGCCTCAGGGAGCACAGCTGTCCAGAGCAGCTGTCA GCCTGCAAGCCTGAAACACTCCCTCGGTAAAGTCCTTCCTACTCAGGACAGAAATGACGAGAACAGGGAGCTGGAAACAGGCC CCTAACCAGAGAAGGGAAGTAATGGATCAACAAAGTTAACTAGCAGGTCAGGATCACGCAATTCATTTCACTCTGACTGGTAA CATGTGACAGAAACAGTGTAGGCTTATTGTATTTTCATGTAGAGTAGGACCCAAAAATCCACCCAAAGTCCTTTATCTATGCC ACATCCTTCTTATCTATACTTCCAGGACACTTTTTCTTCCTTATGATAAGGCTCTCTCTCTCTCCACACACACACACACACAC ACACACACACACACACACACACACACAAACACACACCCCGCCAACCAAGGTGCATGTAAAAAGATGTAGATTCCTCTGCCTTT CTCATCTACACAGCCCAGGAGGGTAAGTTAATATAAGAGGGATTTATTGGTAAGAGATGATGCTTAATCTGTTTAACACTGGG CCTCAAAGAGAGAATTTCTTTTCTTCTGTACTTATTAAGCACCTATTATGTGTTGAGCTTATATATACAAAGGGTTATTATAT GCTAATATAGTAATAGTAATGGTGGTTGGTACTATGGTAATTACCATAAAAATTATTATCCTTTTAAAATAAAGCTAATTATT ATTGGATCTTTTTAGTATTCATTTTATGTTTTTTATGTTTTTGATTTTTAAAAGACAATCTCACCCTGTTACCCAGGCTGG AGTGCAGTGGTGCAATCATAGCTTTCTGCAGTCTTGAACTCCTGGGCTCAAGCAATCCTCCTGCCTTGGCCTCCCAAAGTGTT GGGATACAGTCATGAGCCACTGCATCTGGCCTAGGATCCATTTAGATTAAAATATGCATTTTAAATTTTAAAATAATATGGCT AATTTTTACCTTATGTAATGTGTATACTGGCAATAAATCTAGTTTGCTGCCTAAAGTTTAAAGTGCTTTCCAGTAAGCTTCAT GTACGTGAGGGGAGACATTTAAAGTGAAACAGACAGCCAGGTGTGGTGGCTCACGCCTGTAATCCCAGCACTCTGGGAGGCTG AGGTGGGTGGATCGCTTGAGCCCTGGAGTTCAAGACCAGCCTGAGCAACATGGCAAAACGCTGTTTCTATAACAAAAATTAGC CGGGCATGGTGGCATGTGCCTGTGGTCCCAGCTACTAGGGGCTGAGGCAGGAGAATCGTTGGAGCCCAGGAGGTCAAGGCTG CACTGAGCAGTGCTTGCGCCACTGCACTCCAGCCTGGGTGACAGGACCAGACCTTGCCTCAAAAAAATAAGAAGAAAATTAA
```

```
AAATAAATGGAAACAACTACAAAGAGCTGTTGTCCTAGATGAGCTACTTAGTTAGGCTGATATTTTGGTATTTAACTTTTAAA
GTCAGGGTCTGTCACCTGCACTACATTATTAAAATATCAATTCTCAATGTATATCCACACAAAGACTGGTACGTGAATGTTCA
TAGTACCTTTATTCACAAAACCCCAAAGTAGAGACTATCCAAATATCCATCAACAAGTGAACAAATAAACAAAATGTGCTATA
TCCATGCAATGGAATACCACCCTGCAGTACAAAGAAGCTACTTGGGGATGAATCCCAAAGTCATGACGCTAAATGAAAGAGTC
AGACATGAAGGAGGAGATAATGTATGCCATACGAAATTCTAGAAAATGAAAGTAACTTATAGTTACAGAAAGCAAATCAGGGC
AGGCATAGAGGCTCACACCTGTAATCCCAGCACTTTGAGAGGCCACGTGGGAAGATTGCTAGAACTCAGGAGTTCAAGACCAG
CCTGGGCAACACAGTGAAACTCCATTCTCCACAAAAATGGGAAAAAAGAAAGCAAATCAGTGGTTGTCCTGTGGGGAGGGGA
AGGACTGCAAAGAGGGAAGAAGCTCTGGTGGGGTGAGGGTGGTGATTCAGGTTCTGTATCCTGACTGTGGTAGCAGTTTGGGG
TGTTTACATCCAAAAATATTCGTAGAATTATGCATCTTAAATGGGTGGAGTTTACTGTATGTAAATTATACCTCAATGTAAGA
AAAAATAATGTGTAAGAAAACTTTCAATTCTCTTGCCAGCAAACGTTATTCAAATTCCTGAGCCCTTTACTTCGCAAATTCTC
TGCACTTCTGCCCCGTACCATTAGGTGACAGCACTAGCTCCACAAATTGGATAAATGCATTTCTGGAAAAGACTAGGGACAAA
ATCCAGGCATCACTTGTGCTTTCATATCAACCATGCTGTACAGCTTGTGTTGCTGTCTGCAGCTGCAATGGGGACTCTTGATT
TCTTTAAGGAAACTTGGGTTACCAGAGTATTTCCACAAATGCTATTCAAATTAGTGCTTATGATATGCAAGACACTGTGCTAG
GAGCCAGAAAACAAAGAGGAGGAGAAATCAGTCATTATGTGGGAACAACATAGCAAGATATTTAGATCATTTTGACTAGTTAA
AAAAGCAGCAGAGTACAAAATCACACATGCAATCAGTATAATCCAAATCATGTAAATATGTGCCTGTAGAAAGACTAGAGGAA
TAAACACAAGAATCTTAACAGTCATTGTCATTAGACACTAAGTCTAATTATTATTATTAGACACTATGATATTTGAGATTTAA
AAAATCTTTAATATTTTAAAATTTAGAGCTCTTCTATTTTTCCATAGTATTCAAGTTTGACAATGATCAAGTATTACTCTTTC
TTTTTTTTTTTTTTTTTTTTTTGAGATGGAGTTTTGGTCTTGTTGCCCATGCTGGAGTGGAATGGCATGACCATAGCTCA
CTGCAACCTCCACCTCCTGGGTTCAAGCAAAGCTGTCGCCTCAGCCTCCCGGGTAGATGGGATTACAGGCGCCCACCACCACA
CTCGGCTAATGTTTGTATTTTTAGTAGAGATGGGGTTTCACCATGTTGGCCAGGCTGGTCTCAAACTCCTGACCTCAGAGGAT
CCACCTGCCTCAGCCTCCCAAAGTGCTGGGATTACAGATGTAGGCCACTGCGCCCGGCCAAGTATTGCTCTTATACATTAAAA
AACAGGTGTGAGCCACTGCGCCCAGCCAGGTATTGCTCTTATACATTAAAAAATAGGCCGGTGCAGTGGCTCACGCCTGTAAT
CCCAGCACTTTGGGAAGCCAAGGCGGGCAGAACACCCGAGGTCAGGAGTCCAAGGCCAGCCTGGCCAAGATGGTGAAACCCCG
TCTCTATTAAAAATACAAACATTACCTGGGCATGATGGTGGGCGCCTGTAATCCCAGCTACTCAGGAGGCTGAGGCAGGAGA
TCCGCGGAGCCTGGCAGATCTGCCTGAGCCTGGGAGGTTGAGGCTACAGTAAGCCAAGATCATGCCAGTATACTTCAGCCTGG
GCGACAAAGTGAGACCGTAACAAAAAAAAAAAAATTTAAAAAAGAAATTTAGATCAAGATCCAACTGTAAAAGTGGCCTAA
ACACCACATTAAAGAGTTTGGAGTTTATTCTGCAGGCAGAAGAGAACCATCAGGGGGTCTTCAGCATGGGAATGGCATGGTGC
ACCTGGTTTTTGTGAGATCATGGTGGTGACAGTGTGGGGAATGTTATTTTGGAGGGACTGGAGGCAGACAGACCGGTTAAAAG
GCCAGCACAACAGATAAGGAGGAAGAAGATGAGGGCTTGGACCGAAGCAGAGAAGAGCAAACAGGGAAGGTACAAATTCAAGA
AATATTGGGGGGTTTGAATCAACACATTTAGATGATTAATTAAATATGAGGACTGAGGAATAAGAAATGAGTCAAGGATGGTT
CCAGGCTGCTAGGCTGCTTACCTGAGGTGGCAAAGTCGGGAGGAGTGGCAGTTTAGGACAGGGGCAGTTGAGGAATATTGTT
TTGATCATTTTGAGTTTGAGGTACAAGTTGGACACTTAGGTAAAGACTGGAGGGGAAATCTGAATATACAATTATGGGACTGA
GGAACAAGTTTATTTTATTTTTGTTTCGTTTTCTTGTTGAAGAACAAATTTAATTGTAATCCCAAGTCATCAGCATCTAGAA
GACAGTGGCAGGAGGTGACTGTCTTGTGGGTAAGGGTTTGGGGTCCTTGATGAGTATCTCTCAATTGGCCTTAAATATAAGCA
GGAAAAGGAGTTTATGATGGATTCCAGGCTCAGCAGGGCTCAGGAGGGCTCAGGCAGCCAGCAGAGGAAGTCAGAGCATCTTC
TTTGGTTTAGCCCAAGTAATGACTTCCTTAAAAAGCTGAAGGAAAATCCAGAGTGACCAGATTATAAACTGTACTCTTGCATT
TTCTCTCCCTCCTCTCACCCACAGCCTCTTGATGAACCGGAGGAAGTTTCTTTACCAATTCAAAAATGTCCGCTGGGCTAAGG
GTCGGCGTGAGACCTACCTGTGCTACGTAGTGAAGAGGCGTGACAGTGCTACATCCTTTTCACTGGACTTTGGTTATCTTCGC
AATAAGGTATCAATTAAAGTCGGCTTTGCAAGCAGTTTAATGGTCAACTGTGAGTGCTTTTAGAGCCACCTGCTGATGGTATT
ACTTCCATCCTTTTTTGGCATTTGTGTCTCTATCACATTCCTCAAATCCTTTTTTTATTTCTTTTTCCATGTCCATGCACCC
ATATTAGACATGGCCCAAAATATGTGATTTAATTCCTCCCCAGTAATGCTGGGCACCCTAATACCACTCCTTCCTTCAGTGCC
```

-continued

```
AAGAACAACTGCTCCCAAACTGTTTACCAGCTTTCCTCAGCATCTGAATTGCCTTTGAGATTAATTAAGCTAAAAGCATTTTT

ATATGGGAGAATATTATCAGCTTGTCCAAGCAAAAATTTTAAATGTGAAAAACAAATTGTGTCTTAAGCATTTTTGAAAATTA

AGGAAGAAGAATTTGGGAAAAAATTAACGGTGGCTCAATTCTGTCTTCCAAATGATTTCTTTTCCCTCCTACTCACATGGGTC

GTAGGCCAGTGAATACATTCAACATGGTGATCCCCAGAAAACTCAGAGAAGCCTCGGCTGATGATTAATTAAATTGATCTTTC

GGCTACCCGAGAGAATTACATTTCCAAGAGACTTCTTCACCAAAATCCAGATGGGTTTACATAAACTTCTGCCCACGGGTATC

TCCTCTCTCCTAACACGCTGTGACGTCTGGGCTTGGTGGAATCTCAGGGAAGCATCCGTGGGGTGGAAGGTCATCGTCTGGCT

CGTTGTTTGATGGTTATATTACCATGCAATTTTCTTTGCCTACATTTGTATTGAATACATCCCAATCTCCTTCCTATTCGGTG

ACATGACACATTCTATTTCAGAAGGCTTTGATTTTATCAAGCACTTTCATTTACTTCTCATGGCAGTGCCTATTACTTCTCTT

ACAATACCCATCTGTCTGCTTTACCAAAATCTATTTCCCCTTTTCAGATCCTCCCAAATGGTCCTCATAAACTGTCCTGCCTC

CACCTAGTGGTCCAGGTATATTTCCACAATGTTACATCAACAGGCACTTCTAGCCATTTTCCTTCTCAAAAGGTGCAAAAAGC

AACTTCATAAACACAAATTAAATCTTCGGTGAGGTAGTGTGATGCTGCTTCCTCCCAACTCAGCGCACTTCGTCTTCCTCATT

CCACAAAAACCCATAGCCTTCCTTCACTCTGCAGGACTAGTGCTGCCAAGGGTTCAGCTCTACCTACTGGTGTGCTCTTTTGA

GCAAGTTGCTTAGCCTCTCTGTAACACAAGGACAATAGCTGCAAGCATCCCCAAAGATCATTGCAGGAGACAATGACTAAGGC

TACCAGAGCCGCAATAAAAGTCAGTGAATTTTAGCGTGGTCCTCTCTGTCTCTCCAGAACGGCTGCCACGTGGAATTGCTCTT

CCTCCGCTACATCTCGGACTGGGACCTAGACCCTGGCCGCTGCTACCGCGTCACCTGGTTCACCTCCTGGAGCCCCTGCTACG

ACTGTGCCCGACATGTGGCCGACTTTCTGCGAGGGAACCCCAACCTCAGTCTGAGGATCTTCACCGCGCGCCTCTACTTCTGT

GAGGACCGCAAGGCTGAGCCCGAGGGGCTGCGGCGGCTGCACCGCGCCGGGGTGCAAATAGCCATCATGACCTTCAAAGGTGC

GAAAGGGCCTTCCGCGCAGGCGCAGTGCAGCAGCCCGCATTCGGGATTGCGATGCGAATGAATGAGTTAGTGGGGAAGCTCG

AGGGGAAGAAGTGGGCGGGGATTCTGGTTCACCTCTGGAGCCGAAATTAAAGATTAGAAGCAGAGAAAAGAGTGAATGGCTCA

GAGACAAGGCCCCGAGGAAATGAGAAAATGGGGCCAGGGTTGCTTCTTTCCCCTCGATTTGGAACCTGAACTGTCTTCTACCC

CCATATCCCCGCCTTTTTTTCCTTTTTTTTTTTGAAGATTATTTTTACTGCTGGAATACTTTTGTAGAAAACCACGAAAGA

ACTTTCAAAGCCTGGGAAGGGCTGCATGAAAATTCAGTTCGTCTCTCCAGACAGCTTCGGCGCATCCTTTTGGTAAGGGCTT

CCTCGCTTTTTAAATTTTCTTTCTTTCTCTACAGTCTTTTTTGGAGTTTCGTATATTTCTTATATTTTCTTATTGTTCAATCA

CTCTCAGTTTTCATCTGATGAAAACTTTATTTCTCCTCCACATCAGCTTTTTCTTCTGCTGTTTCACCATTCAGAGCCCTCTG

CTAAGGTTCCTTTTCCCTCCCTTTTCTTTCTTTTGTTGTTTCACATCTTTAAATTTCTGTCTCTCCCCAGGGTTGCGTTTCCT

TCCTGGTCAGAATTCTTTTCTCCTTTTTTTTTTTTTTTTTTTTTTTAAACAAACAAACAAAAAACCCAAAAAAACTCTT

TCCCAATTTACTTTCTTCCAACATGTTACAAAGCCATCCACTCAGTTTAGAAGACTCTCCGGCCCCACCGACCCCCAACCTCG

TTTTGAAGCCATTCACTCAATTTGCTTCTCTCTTTCTCTACAGCCCCTGTATGAGGTTGATGACTTACGAGACGCATTTCGTA

CTTTGGGACTTTGATAGCAACTTCCAGGAATGTCACACACGATGAAATATCTCTGCTGAAGACAGTGGATAAAAAACAGTCCT

TCAAGTCTTCTCTGTTTTTATTCTTCAACTCTCACTTTCTTAGAGTTTACAGAAAAAATATTTATATACGACTCTTTAAAAAG

ATCTATGTCTTGAAAATAGAGAAGGAACACAGGTCTGGCCAGGGACGTGCTGCAATTGGTGCAGTTTTGAATGCAACATTGTC

CCCTACTGGGAATAACAGAACTGCAGGACCTGGGAGCATCCTAAAGTGTCAACGTTTTCTATGACTTTTAGGTAGGATGAGA

GCAGAAGGTAGATCCTAAAAAGCATGGTGAGAGGATCAAATGTTTTTATATCAACATCCTTTATTATTTGATTCATTTGAGTT

AACAGTGGTGTTAGTGATAGATTTTCTATTCTTTTCCCTTGACGTTTACTTTCAAGTAACACAAACTCTTCCATCAGGCCAT

GATCTATAGGACCTCCTAATGAGAGTATCTGGGTGATTGTGACCCCAAACCATCTCTCCAAAGCATTAATATCCAATCATGCG

CTGTATGTTTAATCAGCAGAAGCATGTTTTATGTTTGTACAAAAGAAGATTGTTATGGGTGGGGATGGAGGTATAGACCAT

GCATGGTCACCTTCAAGCTACTTTAATAAAGGATCTTAAAATGGGCAGGAGGACTGTGAACAAGACACCCTAATAATGGGTTG

ATGTCTGAAGTAGCAAATCTTCTGGAAACGCAAACTCTTTTAAGGAAGTCCCTAATTTAGAAACACCCACAAACTTCACATAT

CATAATTAGCAAACAATTGGAAGGAAGTTGCTTGAATGTTGGGGAGAGGAAAATCTATTGGCTCTCGTGGGTCTCTTCATCTC

AGAAATGCCAATCAGGTCAAGGTTTGCTACATTTTGTATGTGTGTGATGCTTCTCCCAAAGGTATATTAACTATATAAGAGAG
```

```
TTGTGACAAAACAGAATGATAAAGCTGCGAACCGTGGCACACGCTCATAGTTCTAGCTGCTTGGGAGGTTGAGGAGGGAGGAT

GGCTTGAACACAGGTGTTCAAGGCCAGCCTGGGCAACATAACAAGATCCTGTCTCTCAAAAAAAAAAAAAAAAAAAAGAAAGA

GAGAGGGCCGGGCGTGGTGGCTCACGCCTGTAATCCCAGCACTTTGGGAGGCCGAGCCGGGCGGATCACCTGTGGTCAGGAGT

TTGAGACCAGCCTGGCCAACATGGCAAAACCCCGTCTGTACTCAAAATGCAAAAATTAGCCAGGCGTGGTAGCAGGCACCTGT

AATCCCAGCTACTTGGGAGGCTGAGGCAGGAGAATCGCTTGAACCCAGGAGGTGGAGGTTGCAGTAAGCTGAGATCGTGCCGT

TGCACTCCAGCCTGGGCGACAAGAGCAAGACTCTGTCTCAGAAAAAAAAAAAAAAAAGAGAGAGAGAGAGAAAGAGAACAATA

TTTGGGAGAGAAGGATGGGGAAGCATTGCAAGGAAATTGTGCTTTATCCAACAAAATGTAAGGAGCCAATAAGGGATCCCTAT

TTGTCTCTTTTGGTGTCTATTTGTCCCTAACAACTGTCTTTGACAGTGAGAAAAATATTCAGAATAACCATATCCCTGTGCCG

TTATTACCTAGCAACCCTTGCAATGAAGATGAGCAGATCCACAGGAAAACTTGAATGCACAACTGTCTTATTTTAATCTTATT

GTACATAAGTTTGTAAAAGAGTTAAAAATTGTTACTTCATGTATTCATTTATATTTTATATTATTTTGCGTCTAATGATTTTT

TATTAACATGATTTCCTTTTCTGATATATTGAAATGGAGTCTCAAAGCTTCATAAATTTATAACTTTAGAAATGATTCTAATA

ACAACGTATGTAATTGTAACATTGCAGTAATGGTGCTACGAAGCCATTTCTCTTGATTTTTAGTAAACTTTTATGACAGCAAA

TTTGCTTCTGGCTCACTTTCAATCAGTTAAATAAATGATAAATAATTTTGGAAGCTGTGAAGATAAAATACCAAATAAAATAA

TATAAAAGTGATTTATATGAAGTTAAAATAAAAAATCAGTATGATGGAATAAACTTG (SEQ ID NO: 126)
```

Other exemplary deaminases that can be fused to Cas9 according to aspects of this disclosure are provided below. In embodiments, the deaminases are activation-induced deaminases (AID). It should be understood that, in some embodiments, the active domain of the respective sequence can be used, e.g., the domain without a localizing signal (nuclear localization sequence, without nuclear export signal, cytoplasmic localizing signal).

```
Human AID:
MDSLLMNRRKFLYQFKNVRWAKGRRETYLCYVVKRRDSATSFSLDFGYLRNKNGCHVELLFLRYISDWDLDPGRCYRVTWFTSWS PCYDCARHVADFLRGNPNLSLRIFTARLYFCEDRKAEPEGLRRLHRAGVQIAIMTFKDYFYCWNTFVENHERTFKAWEGLHENSV

RLSRQLRRILLPLYEVDDLRDAFRTLGL (SEQ ID NO: 127)

(underline: nuclear localization sequence; double underline: nuclear export signal)

Mouse AID:
MDSLLMKQKKFLYHFKNVRWAKGRHETYLCYVVKRRDSATSCSLDFGHLRNKSGCHVELLFLRYISDWDLDPGRCYRVTWFTSWS PCYDCARHVAEFLRWNPNLSLRIFTARLYFCEDRKAEPEGLRRLHRAGVQIGIMTFKDYFYCWNTFVENRERTFKAWEGLHENSV

RLTRQLRRILLPLYEVDDLRDAFRMLGF (SEQ ID NO: 128)

(underline: nuclear localization sequence; double underline: nuclear export signal)

Canine AID:
MDSLLMKQRKFLYHFKNVRWAKGRHETYLCYVVKRRDSATSFSLDFGHLRNKSGCHVELLFLRYISDWDLDPGRCYRVTWFTSWS PCYDCARHVADFLRGYPNLSLRIFAARLYFCEDRKAEPEGLRRLHRAGVQIAIMTFKDYFYCWNTFVENREKTFKAWEGLHENSV

RLSRQLRRILLPLYEVDDLRDAFRTLGL (SEQ ID NO: 129)

(underline: nuclear localization sequence; double underline: nuclear export signal)

Bovine AID:
MDSLLKKQRQFLYQFKNVRWAKGRHETYLCYVVKRRDSPTSFSLDFGHLRNKAGCHVELLFLRYISDWDLDPGRCYRVTWFTSWS PCYDCARHVADFLRGYPNLSLRIFTARLYFCDKERKAEPEGLRRLHRAGVQIAIMTFKDYFYCWNTFVENHERTFKAWEGLHENS

VRLSRQLRRILLPLYEVDDLRDAFRTLGL (SEQ ID NO: 130)

(underline: nuclear localization sequence; double underline: nuclear export signal)

Rat AID:
MAVGSKPKAALVGPHWERERIWCFLCSTGLGTQQTGQTSRWLRPAATQDPVSPPRSLLMKQRKFLYHFKNVRWAKGRHETYLCYV

VKRRDSATSFSLDFGYLRNKSGCHVELLFLRYISDWDLDPGRCYRVTWFTSWSPCYDCARHVADFLRGNPNLSLRIFTARLTGWG

ALPAGLMSPARPSDYFYCWNTFV
ENHERTFKAWEGLHENSVRLSRRLRRILLPLYEVDDLRDAFRTLGL (SEQ ID NO: 131)

(underline: nuclear localization sequence; double underline: nucleae export signal)
```

-continued

Mouse APOBEC-3-(2):
MGPFCLGCSHRKCYSPIRNLISQETFKFHFKNLGYAKGRKDTFLCYEVTRKDCDSPVSLHHGVFKNKDNI*HAEICFLYWFHDKVL*

*KVLSPREEFKITWYMSWSPCFEC*AEQIVRFLATHHNLSLDIFSSRLYNVQDPETQQNLCRLVQEGAQVAAMDLYEFKKCWKKFVD

NGGRRFRPWKRLLTNFRYQDSKLQEILRPCYIPVPSSSSSTLSNICLTKGLPETRFCVEGRRMDPLSEEEFYSQFYNQRVKHLCY

YHRMKPYLCYQLEQFNGQAPLKGCLLSEKGKQ*HAEILFLDKIRSMELSQVTITCYLTWSPCPNC*AWQLAAFKRDRPDLILHIYTS

RLYFHWKRPFQKGLCSLWQSGILVDVMDLPQFTDCWINFVNPKRPFWPWKGLEIISRRTQRRLRRIKESWGLQDLVNDFGNLQLG

PPMS (SEQ ID NO: 132)

(italic: nucleic acid editing domain)

Rat APOBEC-3:
MGPFCLGCSHRKCYSPIRNLISQETFKFHFKNRLRYAIDRKDTFLCYEVTRKDCDSPVSLHHGVFKNKDNI*HAEICFLYWFHDKV*

*LKVLSPREEFKITWYMSWSPCFEC*AEQVLRFLATHHNLSLDIFSSRLYNIRDPENQQNLCRLVQEGAQVAAMDLYEFKKCWKKFV

DNGGRRFRPWKKLLTNFRYQDSKLQEILRPCYIPVPSSSSSTLSNICLTKGLPETRFCVERRRVHLLSEEEFYSQFYNQRVKHLC

YYHGVKPYLCYQLEQFNGQAPLKGCLLSEKGKQ*HAEILFLDKIRSMELSQVIITCYLTWSPCPNC*AWQLAAFKRDRPDLILHIYT

SRLYFHWKRPFQKGLCSLWQSGILVDVMDLPQFTDCWTNFVNPKRPFWPWKGLEIISRRTQRRLHRIKESWGLQDLVNDFGNLQL

GPPMS (SEQ ID NO: 133)

(italic: nucleic acid editing domain)

*Rhesus macaque* APOBEC-3G:
<u>MVEPMDPRTFVSNFNNRPILSGLNTVWLCCEVKTKDPSGPPLDAKIFQGKVYSKAKYHPEMR</u>FLRWFHKWRQLHHDQEYKVTWYV SWSPCTRCANSVATFLAKDPKVTLTIFVARLYYFWKPDYQQALRILCQKRGGPHATMKIMNYNEFQDCWNKFVDGRGKPFKPRNN LPKHYTLLQATLGELLRHLMDPGTFTSNFNNKPWVSGQHETYLCYKVERLHNDTWVPLNQHRGFLRNQAPNIHGFPKGRHAELCF LDLIPFWKLDGQQYRVTCFTSWSPCFSCAQEMAKFISNNEHVSLCIFAARIYDDQGRYQEGLRALHRDGAKIAMMNYSEFEYCWD

TFVDRQGRPFQPWDGLDEHSQALSGRLRAI (SEQ ID NO: 134)

(italic: nucleic acid editing domain; underline: cytoplasmic localization signal)

Chimpanzee APOBEC-3G:
<u>MKPHFRNPVERMYQDTFSDNFYNRPILSHRNTVWLCYEVKTKGPSRPPLDAKIFRGQVYS</u>KLKY*HPEMRFFHWFSKWRKLHRDQE YEVTWYISWSPCTKC*TRDVATFLAEDPKVTLTIFVARLYYFWDPDYQEALRSLCQKRDGPRATMKIMNYDEFQHCWSKFVYSQRE LFEPWNNLPKYYILLHIMLGEILRHSMDPPTFTSNFNNELWVRGRHETYLCYEVERLHNDTWVLLNQRRGFLCNQAPHKHGFLEG R*HAELCFLDVIPFWKLDLHQDYRVTCFTSWSPCFSC*AQEMAKFISNNKHVSLCIFAARIYDDQGRCQEGLRTLAKAGAKISIMTY

SEFKHCWDTFVDHQGCPFQPWDGLEEHSQALSGRLRAILQNQGN (SEQ ID NO: 135)

(italic: nucleic acid editing domain; underline: cytoplasmic localization signal)

Green monkey APOBEC-3G:
<u>MNPQIRNMVEQMEPDIFVYYFNNRPILSGRNTVWLCYEVKTKDPSGPPLDANIFQGKLYP</u>EAKD*HPEMKFLHWFRKWRQLHRDQE YEVTWYVSWSPCTRC*ANSVATFLAEDPKVTLTIFVARLYYFWKPDYQQALRILCQERGGPHATMKIMNYNEFQHCWNEFVDGQGK PFKPRKNLPKHYTLLHATLGELLRHVMDPGTFTSNFNNKPWVSGQRETYLCYKVERSHNDTWVLLNQHRGFLRNQAPDRHGFPKG R*HAELCFLDLIPFWKLDDQQYRVTCFTSWSPCFSC*AQKAMKFISNNKHVSLCIFAARIYDDQGRCQEGLRTLHRDGAKIAVMNYS

EFEYCWDTFVDRQGRPFQPWDGLDEHSQALSGRLRAI (SEQ ID NO: 136)

(italic: nucleic acid editing domain; underline: cytoplasmic localization signal)

Human APOBEC-3G:
<u>MKPHFRNTVERMYRDTFSYNFYNRPILSRRNTVWLCYEVKTKGPSRPPLDAKIFRGQVYS</u>ELKY*HPEMRFFHWFSKWRKLHRDQE YEVTWYISWSPCTKC*TRDMATFLAEDPKVTLTIFVARLYYFWDPDYQEALRSLCQKRDGPRATMKIMNYDEFQHCWSKFVYSQRE LFEPWNNLPKYYILLHIMLGEILRHSMDPPTFTFNFNNEPWVRGRHETYLCYEVERMHNDTWVLLNQRRGFLCNQAPHKHGFLEG R*HAELCFLDVIPFWKLDLDQDYRVTCFTSWSPCFSC*AQEMAKFISKNKHVSLCIFTARIYDDQGRCQEGLRTLAEAGAKISIMTY

SEFKHCWDTFVDHQGCPFQPWDGLDEHSQDLSGRLRAILQNQEN (SEQ ID NO: 137)

(italic: nucleic acid editing domain; underline: cytoplasmic localization signal)

Human APOBEC-3F:
MKPHFRNTVERMYRDTFSYNFYNRPILSRRNTVWLCYEVKTKGPSRPRLDAKIFRGQVYSQPEH*HAEMCFLSWFCGNQLPAYKCF*

*QITWFVSWTPCPDC*VAKLAEFLAEHPNVTLTISAARLYYYWERDYRRALCRLSQAGARVKIMDDEEFAYCWENFVYSEGQPFMPW

YKFDDNYAFLHRTLKEILRNPMEAMYPHIFYFHFKNLRKAYGRNESWLCFTMEVVKHHSPVSWKRGVFRNQVDPETH*CHAERCFL*

*SWFCDDILSPNTNYEVTWYTSWSPCPEC*AGEVAEFLARHSNVNLTIFTARLYYFWDTDYQEGLRSLSQEGASVEIMGYKDFKYCW

ENFVYNDDEPFKPWKGLKYNFLFLDSKLQEILE (SEQ ID NO: 138)

(italic: nucleic acid editing domain)

Human APOBEC-3B:
MNPQIRNPMERMYRDTFYDNFENEPILYGRSYTWLCYEVKIKRGRSNLLWDTGVFRGQVYFKPQY*HAEMCFLSWFCGNQLPAYKC*

*FQITWFVSWTPCPDC*VAKLAEFLSEHPNVTLTISAARLYYYWERDYRRALCRLSQAGARVTIMDYEEFAYCWENFVYNEGQQFMP

WYKFDENYAFLHRTLKEILRYLMDPDTFTFNFNNDPLVLRRRQTYLCYEVERLDNGTWVLMDQHMGFLCNEAKNLLCGFY*GRHAE*

*LRFLDLVPSLQLDPAQIYRVTWFISWSPCFSWGC*AGEVRAFLQENTHVRLRIFAARIYDYDPLYKEALQMLRDAGAQVSIMTYDE

FEYCWDTFVYRQGCPFQPWDGLEEHSQALSGRLRAILQNQGN (SEQ ID NO: 139)

(italic: nucleic acid editing domain)

Rat APOBEC-3B:
MQPQGLGPNAGMGPVCLGCSHRRPYSPIRNPLKKLYQQTFYFHFKNVRYAWGRKNNFLCYEVNGMDCALPVPLRQGVFRKQGHIH

AELCFIYWFHDKVLRVLSPMEEFKVTWYMSWSPCSKCAEQVARFLAAHRNLSLAIFSSRLYYYLRNPNYQQKLCRLIQEGVHVAA

MDLPEFKKCWNKFVDNDGQPFRPWMRLRINFSFYDCKLQEIFSRMNLLREDVFYLQFNNSHRVKPVQNRYYRRKSYLCYQLERAN

GQEPLKGYLLYKKGEQHVEILFLEKMRSMELSQVRITCYLTWSPCPNCARQLAAFKKDHPDLILRIYTSRLYFWRKKFQKGLCTL

WRSGIHVDVMDLPQFADCWTNFVNPQRPFRPWNELEKNSWRIQRRLRRIKESWGL (SEQ ID NO: 140)

Bovine APOBEC-3B:
DGWEVAFRSGTVLKAGVLGVSMTEGWAGSGHPGQGACVWTPGTRNTMNLLREVLFKQQFGNQPRVPAPYYRRKTYLCYQLKQRND LTLDRGCFRNKKQRHAERFIDKINSLDLNPSQSYKIICYITWSPCPNCANELVNFITRNNHLKLEIFASRLYFHWIKSFKMGLQD

LQNAGISVAVMTHTEFEDCWEQFVDNQSRPFQPWDKLEQYSASIRRRLQRILTAPI (SEQ ID NO: 141)

Chimpanzee APOBEC-3B:
MNPQIRNPMEWMYQRTFYYNFENEPILYGRSYTWLCYEVKIRRGHSNLLWDTGVFRGQMYSPEHHAEMCFLSWFCGNQLSAYKC FQITWFVSWTPCPDCVAKLAKFLAEHPNVTLTISAARLYYYWERDYRRALCRLSQAGARVKIMDDEEFAYCWENFVYNEGQPFMP WYKFDDNYAFLHRTLKEIIRHLMDPDTFTFNFNNDPLVLRRHQTYLCYEVERLDNGTWVLMDQHMGFLCNEAKNLLCGFYGRHAE LRFLDLVPSLQLDPAQIYRVTWFISWSPCFSWGCAGQVRAFLQENTHVRLRIFAARIYDYDPLYKEALQMLRDAGAQVSIMTYDE FEYCWDTFVYRQGCPFQPWDGLEEHSQALSGRLRAILQVRASSLCMVPHRPPPPPQSPGPCLPLCSEPPLGSLLPTGRPAPSLPF LLTASFSFPPPASLPPLPSLSLSPGHLPVPSFHSLTSCSIQPPCSSRIRETEGWASVSKEGRDLG (SEQ ID NO: 142)

Human APOBEC-3C:
MNPQIRNPMKAMYPGTFYFQFKNLWEANDRNETWLCFTVEGIKRRSVVSWKTGVFRNQVDSETH*CHAERCFLSWFCDDILSPNTK*

*YQVTWYTSWSPCPDC*AGEVAEFLARHSNVNLTIFTARLYYFQYPCYQEGLRSLSQEGVAVEIMDYEDFKYCWENFVYNDNEPFKP

WKGLKTNFRLLKRRLRESLQ (SEQ ID NO: 143)

(italic: nucleic acid editing domain)

Gorilla APOBEC-3C
MNPQIRNPMKAMYPGTFYFQFKNLWEANDRNETWLCFTVEGIKRRSVVSWKTGVFRNQVDSETH*CHAERCFLSWECDDILSPNTN*

*YQVTWYTSWSPCPEC*AGEVAEFLARHSNVNLTIFTARLYYFQDTDYQEGLRSLSQEGVAVKIMDYKDFKYCWENFVYNDDEPFKP

WKGLKYNFRFLKRRLQEILE (SEQ ID NO: 144)

(italic: nucleic acid editing domain)

Human APOBEC-3A:
MEASPASGPRHLMDPHIFTSNFNNGIGRHKTYLCYEVERLDNGTSVKMDQHRGFLHNQAKNLLCGFYGR*HAELRFLDLVPSLQLD*

*PAQIYRVTWFISWSPCFSW*GCAGEVRAFLQENTHVRLRIFAARIYDYDPLYKEALQMLRDAGAQVSIMTYDEFKHCWDTFVDHQG

CPFQPWDGLDEHSQALSGRLRAILQNQGN (SEQ ID NO: 145)

(italic: nucleic acid editing domain)

*Rhesus macaque* APOBEC-3A:
MDGSPASRPRHLMDPNTFTFNFNNNDLSVRGRHQTYLCYEVERLDNGTWVPMDERRGFLCNKAKNVPCGDYGC*HVELRFLCEVPSW*

*QLDPAQTYRVTWFISWSPC*FRRGCAGQVRVFLQENKHVRLRIFAARIYDYDPLYQEALRTLRDAGAQVSIMTYEEFKHCWDTFVD

RQGRPFQPWDGLDEHSQALSGRLRAILQNQGN (SEQ ID NO: 146)

(italic: nucleic acid editing domain)

Bovine APOBEC-3A:
MDEYTFTENFNNQGWPSKTYLCYEMERLDGDATIPLDEYKGFVRNKGLDQPEKPC*HAELYFLGKIHSWNLDRNQHYRLTCFISWS*

*PCY*DCAQKLITFLKENHHISLHILASRIYTHNRFGCHQSGLCELQAAGARITIMTFEDFKHCWETFVDHKGKPFQPWEGLNVKSQ

ALCTELQAILKTQQN (SEQ ID NO: 147)

(italic: nucleic acid editing domain)

Human APOBEC-3H:
MALLTAETFRLQFNNKRRLRRPYYPRKALLCYQLTPQNGSTPTRGYFENKKKC*HAEICFINEIKSMGLDETQCYQVTCYLTWSPC*

SSCAWELVDFIKAHDHLNLGIFASRLYYHWCKPQQKGLRLLCGSQVPVEVMGFPKFADCWENFVDHEKPLSFNPYKMLEELDKNS

RAIKRRLERIKIPGVRAQGRYMDILCDAEV (SEQ ID NO: 148)

(italic: nucleic acid editing domain)

*Rhesus macaque* APOBEC-3H:
MALLTAKTFSLQFNNKRRVNKPYYPRKALLCYQLTPQNGSTPTRGHLKNKKKDHAEIRFINKIKSMGLDETQCYQVTCYLTWSPC PSCAGELVDFIKAHRHLNLRIFASRLYYHWRPNYQEGLLLLCGSQVPVEVMGLPEFTDCWENFVDHKEPPSFNPSEKLEELDKNS

QAIKRRLERIKSRSVDVLENGLRSLQLGPVTPSSSIRNSR (SEQ ID NO: 149)

Human APOBEC-3D:
MNPQIRNPMERMYRDTFYDNFENEPILYGRSYTWLCYEVKIKRGRSNLLWDTGVFRGPVLPKRQSNHRQEVYFRFENHAEMCFLS WFCGNRLPANRRFQITWFVSWNPCTPCVVKVTKFLAEHPNVTLTISAARLYYYRDRDWRWVLLRLHKAGARVKIMDYEDFAYCWE NFVCNEGQPFMPWYKFDDNYASLHRTLKEILRNPMEAMYPHIFYFHFKNLLKACGRNESWLCFTMEVTKHHSAVFRKRGVFRNQV DPETHCHAERCFLSWFCDDILSPNTNYEVTWYTSWSPCPECAGEVAEFLARHSNVNLTIFTARLCYFWDTDYQEGLCSLSQEGAS

VKIMGYKDFVSCWKNFVYSDDEPFKPWKGLQTNFRLLKRRLREILQ (SEQ ID NO: 150)

(italic: nucleic acid editing domain)

Human APOBEC-1:
MTSEKGPSTGDPTLRRRIEPWEFDVFYDPRELRKEACLLYEIKWGMSRKIWRSSGKNTINHVEVNFIKKFTSERDFHPSMSCSIT WFLSWSPCWECSQAIREFLSRHPGVTLVIYVARLFWHMDQQNRQGLRDLVNSGVTIQIMRASEYYHCWRNFVNYPPGDEAHWPQY PPLWMMLYALELHCIILSLPPCLKISRRWQNHLTFFRLHLQNCHYQTIPPHILLATGLIHPSVAWR (SEQ ID NO: 151)

Mouse APOBEC-1:
MSSETGPVAVDPTLRRRIEPHEFEVFFDPRELRKETCLLYEINWGGRHSVWRHTSQNTSNHVEVNFLEKFTTERYFRPNTRCSIT WFLSWSPCGECSRAITEFLSRHPYVTLFIYIARLYHHTDQRNRQGLRDLISSGVTIQIMTEQEYCYCWRNFVNYPPSNEAYWPRY

PHLWVKLYVLELYCIILGLPPCLKILRRKQPQLTFFTITLQTCHYQRIPPHLLWATGLK (SEQ ID NO: 152)

Rat APOBEC-1:
MSSETGPVAVDPTLRRRIEPHEFEVFFDPRELRKETCLLYEINWGGRHSIWRHTSQNTNKHVEVNFIEKFTTERYFCPNTRCSIT

WFLSWSPCGECSRAITEFLSRYPHVTLFIYIARLYHHADPRNRQGLRDLISSGVTIQIMTEQESGYCWRNFVNYSPSNEAHWPRY

PHLWVRLYVLELYCIILGLPPCLNILRRKQPQLTFFTIALQSCHYQRLPPHILWATGLK (SEQ ID NO: 153)

Human APOBEC-2:
MAQKEEAAVATEAASQNGEDLENLDDPEKLKELIELPPFEIVTGERLPANFFKFQFRNVEYSSGRNKTFLCYVVEAQGKGGQVQA SRGYLEDEHAAAHAEEAFFNTILPAFDPALRYNVTWYVSSSPCAACADRIIKTLSKTKNLRLLILVGRLFMWEEPEIQAALKKLK

EAGCKLRIMKPQDFEYVWQNFVEQEEGESKAFQPWEDIQENFLYYEEKLADILK (SEQ ID NO: 154)

Mouse APOBEC-2:
MAQKEEAAEAAAPASQNGDDLENLEDPEKLKELIDLPPFEIVTGVRLPVNFFKFQFRNVEYSSGRNKTFLCYVVEVQSKGGQAQA TQGYLEDEHAGAHAEEAFFNTILPAFDPALKYNVTWYVSSSPCAACADRILKTLSKTKNLRLLILVSRLFMWEEPEVQAALKKLK

EAGCKLRIMKPQDFEYIWQNFVEQEEGESKAFEPWEDIQENFLYYEEKLADILK (SEQ ID NO: 155)

Rat APOBEC-2:
MAQKEEAAEAAAPASQNGDDLENLEDPEKLKELIDLPPFEIVTGVRLPVNFFKFQFRNVEYSSGRNKTFLCYVVEAQSKGGQVQA

TQGYLEDEHAGAHAEEAFFNTILPAFDPALKYNVTWYVSSSPCAACADRILKTLSKTKNLRLLILVSRLFMWEEPEVQAALKKLK

EAGCKLRIMKPQDFEYLWQNFVEQEEGESKAFEPWEDIQENFLYYEEKLADILK (SEQ ID NO: 156)

Bovine APOBEC-2:
MAQKEEAAAAAEPASQNGEEVENLEDPEKLKELIELPPFEIVTGERLPAHYFKFQFRNVEYSSGRNKTFLCYVVEAQSKGGQVQA SRGYLEDEHATNHAEEAFFNSIMPTFDPALRYMVTWYVSSSPCAACADRIVKTLNKTKNLRLLILVGRLFMWEEPEIQAALRKLK

EAGCRLRIMKPQDFEYIWQNFVEQEEGESKAFEPWEDIQENFLYYEEKLADILK (SEQ ID NO: 157)

Petromyzon marinus CDA1 (pmCDA1):
MTDAEYVRIHEKLDIYTFKKQFFNNKKSVSHRCYVLFELKRRGERRACFWGYAVNKPQSGTERGIHAEIFSIRKVEEYLRDNPGQ FTINWYSSWSPCADCAEKILEWYNQELRGNGHTLKIWACKLYYEKNARNQIGLWNLRDNGVGLNVMVSEHYQCCRKIFIQSSHNQ

LNENRWLEKTLKRAEKRRSELSFMIQVKILHTTKSPAV (SEQ ID NO: 158)

Human APOBEC3G D316R D317R:
MKPHFRNTVERMYRDTFSYNFYNRPILSRRNTVWLCYEVKTKGPSRPPLDAKIFRGQVYSELKYHPEMRFFHWFSKWRKLHRDQE YEVTWYISWSPCTKCTRDMATFLAEDPKVTLTIFVARLYYFWDPDYQEALRSLCQKRDGPRATMKFNYDEFQHCWSKFVYSQREL FEPWNNLPKYYILLHFMLGEILRHSMDPPTFTFNFNNEPWVRGRHETYLCYEVERMHNDTWVLLNQRRGFLCNQAPHKHGFLEGR HAELCFLDVIPFWKLDLDQDYRVTCFTSWSPCFSCAQEMAKFISKKHVSLCIFTARIYRRQGRCQEGLRTLAEAGAKISFTYSEF

KHCWDTFVDHQGCPFQPWDGLDEHSQDLSGRLRAILQNQEN (SEQ ID NO: 159)

Human APOBEC3G chain A:
MDPPTFTFNFNNEPWWGRHETYLCYEVERMHNDTWVLLNQRRGFLCNQAPHKHGFLEGRHAELCFLDVIPFWKLDLDQDYRVTCF TSWSPCFSCAQEMAKFISKNKHVSLCIFTARIYDDQGRCQEGLRTLAEAGAKISFTYSEFKHCWDTFVDHQGCPFQPWDGLDEHS

QDLSGRLRAILQ (SEQ ID NO: 160)

Human APOBEC3G chain AD120R D121R:
MDPPTFTFNFNNEPWVRGRHETYLCYEVERMHNDTWVLLNQRRGFLCNQAPHKHGFLEGRHAELCFLDVIPFWKLDLDQDYRVTC FTSWSPCFSCAQEMAKFISKNKHVSLCIFTARIYRRQGRCQEGLRTLAEAGAKISFMTYSEFKHCWDTFVDHQGCPFQPWDGLDE

HSQDLSGRLRAILQ (SEQ ID NO: 161)

Some aspects of the present disclosure are based on the recognition that modulating the deaminase domain catalytic activity of any of the fusion proteins described herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deamination window can prevent unwanted deamination of residues adjacent to specific target residues, which can decrease or prevent off-target effects.

For example, in some embodiments, an APOBEC deaminase incorporated into a base editor can comprise one or more mutations selected from the group consisting of H121X, H122X, R26X, R118X, W90X, W90X, and R132X of rAPOBEC1, or one or more corresponding mutations in another APOBEC deaminase, wherein X is any amino acid. In some embodiments, an APOBEC deaminase incorporated into a base editor can comprise one or more mutations selected from the group consisting of H121R, H122R, R26A, R26E, Ri18A, W90A, W90Y, and Ri32E of rAPOBEC1, or one or more corresponding mutations in another APOBEC deaminase.

In some embodiments, an APOBEC deaminase incorporated into a base editor can comprise one or more mutations selected from the group consisting of D316X, D317X, R320X, R320X, R313X, W285X, W285X, R326X of hAPOBEC3G, or one or more corresponding mutations in another APOBEC deaminase, wherein X is any amino acid.

In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G, or one or more corresponding mutations in another APOBEC deaminase.

In some embodiments, an APOBEC deaminase incorporated into a base editor can comprise a H121R and a H122R mutation of rAPOBEC1, or one or more corresponding mutations in another APOBEC deaminase. In some embodiments an APOBEC deaminase incorporated into a base editor can comprise an APOBEC deaminase comprising a R26A mutation of rAPOBEC1, or one or more corresponding mutations in another APOBEC deaminase. In some embodiments, an APOBEC deaminase incorporated into a base editor can comprise an APOBEC deaminase comprising a R26E mutation of rAPOBEC1, or one or more corresponding mutations in another APOBEC deaminase. In some embodiments, an APOBEC deaminase incorporated into a base editor can comprise an APOBEC deaminase comprising a R118A mutation of rAPOBEC1, or one or more corresponding mutations in another APOBEC deaminase. In some embodiments, an APOBEC deaminase incorporated into a base editor can comprise an APOBEC deaminase comprising a W90A mutation of rAPOBEC1, or one or more corresponding mutations in another APOBEC deaminase. In some embodiments, an APOBEC deaminase incorporated into a base editor can comprise an APOBEC deaminase comprising a W90Y mutation of rAPOBEC1, or one or more corresponding mutations in another APOBEC deaminase. In some embodiments, an APOBEC deaminase incorporated into a base editor can comprise an APOBEC deaminase comprising a R132E mutation of rAPOBEC1, or one or more corresponding mutations in another APOBEC deaminase. In some embodiments an APOBEC deaminase incorporated into a base editor can comprise an APOBEC deaminase comprising a W90Y and a R26E mutation of rAPOBEC1, or one or more corresponding mutations in another APOBEC deaminase. In some embodiments, an APOBEC deaminase incorporated into a base editor can comprise an APOBEC deaminase comprising a R26E and a R132E mutation of rAPOBEC1, or one or more corresponding mutations in another APOBEC deaminase. In some embodiments, an APOBEC deaminase incorporated into a base editor can comprise an APOBEC deaminase comprising a W90Y and a R132E mutation of rAPOBEC1, or one or more corresponding mutations in another APOBEC deaminase. In some embodiments, an APOBEC deaminase incorporated into a base editor can comprise an APOBEC deaminase comprising a W90Y, R26E, and R132E mutation of rAPOBEC1, or one or more corresponding mutations in another APOBEC deaminase.

In some embodiments, an APOBEC deaminase incorporated into a base editor can comprise an APOBEC deaminase comprising a D316R and a D317R mutation of hAPOBEC3G, or one or more corresponding mutations in another APOBEC deaminase. In some embodiments, any of the fusion proteins provided herein comprise an APOBEC deaminase comprising a R320A mutation of hAPOBEC3G, or one or more corresponding mutations in another APOBEC deaminase. In some embodiments, an APOBEC deaminase incorporated into a base editor can comprise an APOBEC deaminase comprising a R320E mutation of hAPOBEC3G, or one or more corresponding mutations in another APOBEC deaminase. In some embodiments, an APOBEC deaminase incorporated into a base editor can comprise an APOBEC deaminase comprising a R313A mutation of hAPOBEC3G, or one or more corresponding mutations in another APOBEC deaminase. In some embodiments, an APOBEC deaminase incorporated into a base editor can comprise an APOBEC deaminase comprising a W285A mutation of hAPOBEC3G, or one or more corresponding mutations in another APOBEC deaminase. In some embodiments, an APOBEC deaminase incorporated into a base editor can comprise an APOBEC deaminase comprising a W285Y mutation of hAPOBEC3G, or one or more corresponding mutations in another APOBEC deaminase. In some embodiments, an APOBEC deaminase incorporated into a base editor can comprise an APOBEC deaminase comprising a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R320E mutation of hAPOBEC3G, or one or more corresponding mutations in another APOBEC deaminase. In some embodiments, an APOBEC deaminase incorporated into a base editor can comprise an APOBEC deaminase comprising a R320E and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y, R320E, and R326E mutation of hAPOBEC3G, or one or more corresponding mutations in another APOBEC deaminase.

A number of modified cytidine deaminases are commercially available, including, but not limited to, SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177). In some embodiments, a deaminase incorporated into a base editor comprises all or a portion of an APOBEC1 deaminase.

Details of C to T nucleobase editing proteins are described in International PCT Application No. PCT/US2016/058344 (WO2017/070632) and Komor, A. C., et al., "Programmable editing of a target base in genomic DNA without double-stranded DNA cleavage" Nature 533, 420-424 (2016), the entire contents of which are hereby incorporated by reference.

Fusion Proteins Comprising a Cas9 Domain and an Adenosine Deaminase and/or a Cytidine Deaminase Some aspects of the disclosure provide fusion proteins comprising a Cas9 domain or other nucleic acid programmable DNA binding protein and one or more adenosine deaminase domain, cytidine deaminase domain, and/or DNA glycosylase domains. It should be appreciated that the Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases and adenosine deaminases provided herein. The domains of the base editors disclosed herein can be arranged in any order.

For example, and without limitation, in some embodiments, the fusion protein comprises the structure:

NH₂-[cytidine deaminase]-[Cas9 domain]-[adenosine deaminase]-COOH;
NH₂-[adenosine deaminase]-[Cas9 domain]-[cytidine deaminase]-COOH;
NH₂-[adenosine deaminase]-[cytidine deaminase]-[Cas9 domain]-COOH;
NH₂-[cytidine deaminase]-[adenosine deaminase]-[Cas9 domain]-COOH;
NH₂-[Cas9 domain]-[adenosine deaminase]-[cytidine deaminase]-COOH; or
NH₂-[Cas9 domain]-[cytidine deaminase]-[adenosine deaminase]-COOH.

In some embodiments, the adenosine deaminase of the fusion protein comprises a TadA*8 and a cytidine deaminase. In some embodiments, the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

Exemplary fusion protein structures include the following:
NH₂-[adenosine deaminase]-[Cas9]-[cytidine deaminase]-COOH;
NH₂-[cytidine deaminase]-[Cas9]-[adenosine deaminase]-COOH;
NH₂-[TadA*8]-[Cas9]-[cytidine deaminase]-COOH; or
NH₂-[cytidine deaminase]-[Cas9]-[TadA*8]-COOH.

In some embodiments, the fusion proteins comprising a cytidine deaminase, abasic editor, and adenosine deaminase and a napDNAbp (e.g., Cas9 domain) do not include a linker sequence. In some embodiments, a linker is present between the cytidine deaminase and adenosine deaminase domains and the napDNAbp. In some embodiments, the "-" used in the general architecture above indicates the presence of an optional linker. In some embodiments, the cytidine deaminase and adenosine deaminase and the napDNAbp are fused via any of the linkers provided herein. For example, in some embodiments the cytidine deaminase and adenosine deaminase and the napDNAbp are fused via any of the linkers provided below in the section entitled "Linkers".

In some embodiments, the general architecture of exemplary Cas9 or Cas12 fusion proteins with a cytidine deaminase, adenosine deaminase and a Cas9 or Cas12 domain comprises any one of the following structures, where NLS is a nuclear localization sequence (e.g., any NLS provided herein), NH₂ is the N-terminus of the fusion protein, and COOH is the C-terminus of the fusion protein.

NH₂-NLS-[cytidine deaminase]-[Cas9 domain]-[adenosine deaminase]-COOH;
NH₂-NLS-[adenosine deaminase]-[Cas9 domain]-[cytidine deaminase]-COOH;
NH₂-NLS-[adenosine deaminase] [cytidine deaminase]-[Cas9 domain]-COOH;
NH₂-NLS-[cytidine deaminase]-[adenosine deaminase]-[Cas9 domain]-COOH;
NH₂-NLS-[Cas9 domain]-[adenosine deaminase]-[cytidine deaminase]-COOH;
NH₂-NLS-[Cas9 domain]-[cytidine deaminase]-[adenosine deaminase]-COOH;
NH₂-[cytidine deaminase]-[Cas9 domain]-[adenosine deaminase]-NLS-COOH;
NH₂-[adenosine deaminase]-[Cas9 domain]-[cytidine deaminase]-NL2-COOH;
NH₂-[adenosine deaminase] [cytidine deaminase]-[Cas9 domain]-NLS-COOH;
NH₂-[cytidine deaminase]-[adenosine deaminase]-[Cas9 domain]-NLS-COOH;
NH₂-[Cas9 domain]-[adenosine deaminase]-[cytidine deaminase]-NLS-COOH; or
NH₂-[Cas9 domain]-[cytidine deaminase]-[adenosine deaminase]-NLS-COOH.

In some embodiments, the NLS is present in a linker or the NLS is flanked by linkers, for example described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 122), is the prototype of the ubiquitous bipartite signal: two clusters of basic amino acids, separated by a spacer of about 10 amino acids. The sequence of an exemplary bipartite NLS follows: PKKKRKVEGADKRTADGSEFESPKKKRKV (SEQ ID NO: 120).

In some embodiments, the fusion proteins comprising a cytidine deaminase, adenosine deaminase, a Cas9 domain and an NLS do not comprise a linker sequence. In some embodiments, linker sequences between one or more of the domains or proteins (e.g., cytidine deaminase, adenosine deaminase, Cas9 domain or NLS) are present.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Exemplary, yet nonlimiting, fusion proteins are described in International PCT Application Nos. PCT/2017/044935 and PCT/US2020/016288, each of which is incorporated herein by reference for its entirety.

Adenosine Deaminases

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the adenosine deaminases provided herein are capable of deaminating adenine. In some embodiments, the adenosine deaminases provided herein are capable of deaminating adenine in a deoxyadenosine residue of DNA. In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli*, *Staphylococcus aureus*, *Salmonella typhi*, *Shewanella putrefaciens*, *Haemophilus influenzae*, *Caulobacter crescentus*, or *Bacillus subtilis*. In some embodiments, the adenosine deaminase is from *E. coli*.

The disclosure provides adenosine deaminase variants that have increased efficiency (>50-60%) and specificity. In particular, the adenosine deaminase variants described herein are more likely to edit a desired base within a polynucleotide, and are less likely to edit bases that are not intended to be altered (i.e., "bystanders").

In particular embodiments, the TadA is any one of the TadA described in PCT/US2017/045381 (WO 2018/027078), which is incorporated herein by reference in its entirety.

In some embodiments, the nucleobase editors of the disclosure are adenosine deaminase variants comprising an alteration in the following sequence:

MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD (SEQ ID NO: 3)

(also termed TadA*7.10).

In particular embodiments, the fusion proteins comprise a single (e.g., provided as a monomer) TadA*8 variant. In some embodiments, the TadA*8 is linked to a Cas9 nickase. In some embodiments, the fusion proteins of the disclosure comprise as a heterodimer of a wild-type TadA (TadA(wt)) linked to a TadA*8 variant. In other embodiments, the fusion proteins of the disclosure comprise as a heterodimer of a TadA*7.10 linked to a TadA*8 variant. In some embodiments, the base editor is ABE8 comprising a TadA*8 variant monomer. In some embodiments, the base editor is ABE8 comprising a heterodimer of a TadA*8 variant and a TadA (wt). In some embodiments, the base editor is ABE8 comprising a heterodimer of a TadA*8 variant and TadA*7.10. In some embodiments, the base editor is ABE8 comprising a heterodimer of a TadA*8 variant. In some embodiments, the TadA*8 variant is selected from Table 7. In some embodiments, the ABE8 is selected from Table 7. The relevant sequences follow:

Wild-type TadA (TadA(wt)) or
"the TadA reference sequence"
MSEVEFSHEYWMRHALTLAKRAWDEREVPVGAVLVHNNRVIGEGWN

RPIGRHDPTAHAEIMALRQGGLVMQNYRLIDATLYVTLEPCVMCAG

AMIHSRIGRVVFGARDAKTGAAGSLMDVLHHPGMNHRVEITEGILA

DECAALLSDFFRMRRQEIKAQKKAQSSTD (SEQ ID NO: 2)

TadA*7.10:
MSEVEFSHEYW MRHALTLAKR ARDEREVPVG AVLVLNNRVI

GEGWNRAIGL HDPTAHAEIM ALRQGGLVMQ NYRLIDATLY

VTFEPCVMCA GAMIHSRIGR VVFGVRNAKT GAAGSLMDVL

HYPGMNHRVE ITEGILADEC AALLCYFFRM PRQVFNAQKK

AQSSTD (SEQ ID NO: 3)

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments the TadA deaminase is a full-length *E. coli* TadA deaminase. For example, in certain embodiments, the adenosine deaminase comprises the amino acid sequence:

MRRAFITGVFFLSEVEFSHEYWMRHALTLAKRAWDEREVPVGAVLVH

NNRVIGEGWNRPIGRHDPTAHAEIMALRQGGLVMQNYRLIDATLYVT

LEPCVMCAGAMIHSRIGRVVFGARDAKTGAAGSLMDVLHHPGMNHRV

EITEGILADECAALLSDFFRMRRQEIKAQKKAQSSTD
(SEQ ID NO: 162).

It should be appreciated, however, that additional adenosine deaminases useful in the present application would be apparent to the skilled artisan and are within the scope of this disclosure. For example, the adenosine deaminase may be a homolog of adenosine deaminase acting on tRNA (ADAT). Without limitation, the amino acid sequences of exemplary AD AT homologs include the following:

Staphylococcus aureus TadA:
MGSHMTNDIYFMTLAIEEAKKAAQLGEVPIGAIITKDDEVIARAHNLRETLQQPTAHAEHIA

IERAAKVLGSWRLEGCTLYVTLEPCVMCAGTIVMSRIPRWYGADDPKGGCSGSLMNLLQQSN

FNHRAIVDKGVLKEACSTLLTTFFKNLRANKKSTN (SEQ ID NO: 5)

```
Bacillus subtilis TadA:
MTQDELYMKEAIKEAKKAEEKGEVPIGAVLVINGEIIARAHNLRETEQRSIAHAEMLVIDEA

CKALGTWRLEGATLYVTLEPCPMCAGAVVLSRVEKVVFGAFDPKGGCSGTLMNLLQEERFNH

QAEWSGVLEEECGGMLSAFFRELRKKKKAARKNLSE (SEQ ID NO: 6)

Salmonella typhimurium (S. typhimurium) TadA:
MPPAFITGVTSLSDVELDHEYWMRHALTLAKRAWDEREVPVGAVLVHNHRVIGEGWNRPIGR

HDPTAHAEIMALRQGGLVLQNYRLLDTTLYVTLEPCVMCAGAMVHSRIGRVVFGARDAKTGA

AGSLIDVLHHPGMNHRVEIIEGVLRDECATLLSDFFRMRRQEIKALKKADRAEGAGPAV
(SEQ ID NO: 7)

Shewanella putrefaciens (S. putrefaciens) TadA:
MDEYWMQVAMQMAEKAEAAGEVPVGAVLVKDGQQIATGYNLSISQHDPTAHAEILCLRSAGK

KLENYRLLDATLYITLEPCAMCAGAMVHSRIARVVYGARDEKTGAAGTVVNLLQHPAFNHQV

EVTSGVLAEACSAQLSRFFKRRRDEKKALKLAQRAQQGIE (SEQ ID NO: 8)

Haemophilus influenzae F3031 (H. influenzae) TadA:
MDAAKVRSEFDEKMMRYALELADKAEALGEIPVGAVLVDDARNIIGEGWNLSIVQSDPTAHA ElIALRNGAKNIQNYRLLNSTLYVTLEPCTMCAGAILHSRIKRLVFGASDYKTGAIGSRFHF

FDDYKMNHTLEITSGVLAEECSQKLSTFFQKRREEKKIEKALLKSLSDK (SEQ ID NO: 9)

Caulobacter crescentus (C. crescentus) TadA:
MRTDESEDQDHRMMRLALDAARAAAEAGETPVGAVILDPSTGEVIATAGNGPIAAHDPTAHA

EIAAMRAAAAKLGNYRLTDLTLVVTLEPCAMCAGAISHARIGRVVFGADDPKGGAVVHGPKF

FAQPTCHWRPEVTGGVLADESADLLRGFFRARRKAKI (SEQ ID NO: 10)

Geobacter sulfurreducens (G. sulfurreducens) TadA:
MSSLKKTPIRDDAYWMGKAIREAAKAAARDEVPIGAVIVRDGAVIGRGHNLREGSNDPSAHA

EMIAIRQAARRSANWRLTGATLYVTLEPCLMCMGAIILARLERVVFGCYDPKGGAAGSLYDL

SADPRLNHQVRLSPGVCQEECGTMLSDFFRDLRRRKKAKATPALF IDERKVPPEP
(SEQ ID NO: 11)

An embodiment of E. Coli TadA (ecTadA) includes the following:
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCYFFRMPRQVFNAQKKAQSSTD (SEQ ID NO: 23)
```

In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

In one embodiment, a fusion protein of the disclosure comprises a wild-type TadA linked to TadA7.10, which is linked to Cas9 nickase. In particular embodiments, the fusion proteins comprise a single TadA7.10 domain (e.g., provided as a monomer). In other embodiments, the ABE7.10 editor comprises TadA7.10 and TadA(wt), which are capable of forming heterodimers.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

It should be appreciated that any of the mutations provided herein (e.g., based on the TadA reference sequence) can be introduced into other adenosine deaminases, such as *E. coli* TadA (ecTadA), *S. aureus* TadA (saTadA), or other adenosine deaminases (e.g., bacterial adenosine deaminases). It would be apparent to the skilled artisan that additional deaminases may similarly be aligned to identify homologous amino acid residues that can be mutated as provided herein. Thus, any of the mutations identified in the TadA reference sequence can be made in other adenosine deaminases (e.g., ecTada) that have homologous amino acid residues. It should also be appreciated that any of the mutations provided herein can be made individually or in any combination in the TadA reference sequence or another adenosine deaminase.

In some embodiments, the adenosine deaminase comprises a D108X mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a D108G, D108N, D108V, D108A, or D108Y mutation, or a corresponding mutation in another adenosine deaminase.

In some embodiments, the adenosine deaminase comprises an A106X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase (e.g., wild-type TadA or ecTadA).

In some embodiments, the adenosine deaminase comprises a E155X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase (e.g., ecTadA).

In some embodiments, the adenosine deaminase comprises a D147X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase (e.g., ecTadA).

In some embodiments, the adenosine deaminase comprises an A106X, E155X, or D147X, mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

For example, an adenosine deaminase can contain a D108N, a A106V, a E155V, and/or a D147Y mutation in TadA reference sequence, or a corresponding mutation in another adenosine deaminase (e.g., ecTadA). In some embodiments, an adenosine deaminase comprises the following group of mutations (groups of mutations are separated by a ";") in TadA reference sequence, or corresponding mutations in another adenosine deaminase (e.g., ecTadA): D108N and A106V; D108N and E155V; D108N and D147Y; A106V and E155V; A106V and D147Y; E155V and D147Y; D108N, A106V, and E155V; D108N, A106V, and D147Y; D108N, E155V, and D147Y; A106V, E155V, and D147Y; and D108N, A106V, E155V, and D147Y. It should be appreciated, however, that any combination of corresponding mutations provided herein can be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95L, V102A, F104L, A106V, R107C, or R107H, or R107P, D108G, or D108N, or D108V, or D18A, or D108Y, K110I, M118K, N127S, A138V, F149Y, M151V, R153C, Q154L, I156D, and/or K157R mutation in TadA reference sequence, or one or more corresponding mutations in another adenosine deaminase (e.g., ecTadA).

In some embodiments, the adenosine deaminase comprises one or more of a H8X, D108X, and/or N127X mutation in TadA reference sequence, or one or more corresponding mutations in another adenosine deaminase (e.g., ecTadA), where X indicates the presence of any amino acid. In some embodiments, the adenosine deaminase comprises one or more of a H8Y, D108N, and/or N127S mutation in TadA reference sequence, or one or more corresponding mutations in another adenosine deaminase (e.g., ecTadA).

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase (e.g., ecTadA), where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase (e.g., ecTadA).

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R26X, L68X, D108X, N127X, D147X, and E155X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase (e.g., ecTadA). In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, R26W, L68Q, D108N, N127S, D147Y, and E155V in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase (e.g., ecTadA).

Any of the mutations provided herein and any additional mutations (e.g., based on the ecTadA amino acid sequence) can be introduced into any other adenosine deaminases. Any of the mutations provided herein can be made individually or in any combination in TadA reference sequence or another adenosine deaminase (e.g., ecTadA).

Details of A to G nucleobase editing proteins are described in International PCT Application No. PCT/2017/045381 (WO2018/027078) and Gaudelli, N. M., et al., "Programmable base editing of A•T to G•C in genomic DNA without DNA cleavage" Nature, 551, 464-471 (2017), the entire contents of which are hereby incorporated by reference.

In some embodiments, the adenosine deaminase comprises one or more corresponding mutations in another adenosine deaminase (e.g., ecTadA). In some embodiments, the adenosine deaminase comprises a D108N, D108G, or D108V mutation in TadA reference sequence, or corresponding mutations in another adenosine deaminase (e.g., ecTadA). In some embodiments, the adenosine deaminase comprises a A106V and D108N mutation in TadA reference sequence, or corresponding mutations in another adenosine deaminase (e.g., ecTadA). In some embodiments, the adenosine deaminase comprises R107C and D108N mutations in TadA reference sequence, or corresponding mutations in another adenosine deaminase (e.g., ecTadA). In some embodiments, the adenosine deaminase comprises a H8Y, D108N, N127S, D147Y, and Q154H mutation in TadA reference sequence, or corresponding mutations in another adenosine deaminase (e.g., ecTadA). In some embodiments, the adenosine deaminase comprises a H8Y, D108N, N127S, D147Y, and E155V mutation in TadA reference sequence, or corresponding mutations in another adenosine deaminase (e.g., ecTadA). In some embodiments, the adenosine deaminase comprises a D108N, D147Y, and E155V mutation in TadA reference sequence, or corresponding mutations in another adenosine deaminase (e.g., ecTadA). In some embodiments, the adenosine deaminase comprises a H8Y, D108N, and N127S mutation in TadA reference sequence, or corresponding mutations in another adenosine deaminase (e.g., ecTadA). In some embodiments, the adenosine deaminase comprises a A106V, D108N, D147Y and E155V mutation in TadA reference sequence, or corresponding mutations in another adenosine deaminase (e.g., ecTadA).

In some embodiments, the adenosine deaminase comprises one or more of a S2X, H8X, I49X, L84X, H123X, N127X, I156X and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in TadA reference sequence, or one or more corresponding mutations in another adenosine deaminase (e.g., ecTadA).

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase (e.g., ecTadA).

In some embodiments, the adenosine deaminase comprises an H123X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase (e.g., ecTadA).

In some embodiments, the adenosine deaminase comprises an I156X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an I156F mutation in TadA reference sequence, or a corresponding mutation in another adenosine deaminase (e.g., ecTadA).

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase (e.g., ecTadA). In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five, mutations selected from the group consisting of H8Y, A106T, D108N, N127S, and K160S in TadA reference sequence, or a corresponding mutation or mutations in another adenosine deaminase (e.g., ecTadA).

In some embodiments, the adenosine deaminase comprises one or more of a E25X, R26X, R107X, A142X, and/or A143X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R107K, R107A, R107N, R107W, R107H, R107S, A142N, A142D, A142G, A143D, A143G, A143E, A143L, A143W, A143M, A143S, A143Q and/or A143R mutation in TadA reference sequence, or one or more corresponding mutations in another adenosine deaminase (e.g., ecTadA). In some embodiments, the adenosine deaminase comprises one or more of the mutations described herein corresponding to TadA reference sequence, or one or more corresponding mutations in another adenosine deaminase (e.g., ecTadA).

In some embodiments, the adenosine deaminase comprises an E25X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase (e.g., ecTadA).

In some embodiments, the adenosine deaminase comprises an R26X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase (e.g., ecTadA).

In some embodiments, the adenosine deaminase comprises an R107X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an R107P, R107K, R107A, R107N, R107W, R107H, or R107S mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase (e.g., ecTadA).

In some embodiments, the adenosine deaminase comprises an A143X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in TadA reference sequence, or a corresponding mutation in another adenosine deaminase (e.g., ecTadA).

In some embodiments, the adenosine deaminase comprises one or more of a H36X, N37X, P48X, I49X, R51X, M70X, N72X, D77X, E134X, S 146X, Q154X, K157X, and/or K161X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in TadA reference sequence, or one or more corresponding mutations in another adenosine deaminase (e.g., ecTadA).

In some embodiments, the adenosine deaminase comprises an H36X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase (e.g., ecTadA).

In some embodiments, the adenosine deaminase comprises an N37X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an N37T, or N37S mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an P48T, or P48L mutation in TadA reference sequence, or a corresponding mutation in another adenosine deaminase (e.g., ecTadA).

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation in TadA reference sequence, or a corresponding mutation in another adenosine deaminase (e.g., ecTadA).

In some embodiments, the adenosine deaminase comprises an S146X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an S146R, or S146C mutation in TadA reference sequence, or a corresponding mutation in another adenosine deaminase (e.g., ecTadA).

In some embodiments, the adenosine deaminase comprises an K157X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase (e.g., ecTadA).

In some embodiments, the adenosine deaminase comprises an W23X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a W23R, or W23L mutation in TadA reference sequence, or a corresponding mutation in another adenosine deaminase (e.g., ecTadA).

In some embodiments, the adenosine deaminase comprises an R152X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a R152P, or R52H mutation in TadA reference sequence, or a corresponding mutation in another adenosine deaminase (e.g., ecTadA).

In one embodiment, the adenosine deaminase may comprise the mutations H36L, R51L, L84F, A106V, D108N, H123Y, S146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses:

(A106V_D108N),
(R107C_D108N),
(H8Y_D108N_N127S_D147Y_Q154H),
(H8Y_D108N_N127S_D147Y_E155V),
(D108N_D147Y_E155V),
(H8Y_D108N_N127S),
(H8Y_D108N_N127S_D147Y_Q154H),
(A106V_D108N_D147Y_E155V),
(D108Q_D147Y_E155V),
(D108M_D147Y_E155V),
(D108L_D147Y_E155V),
(D108K_D147Y_E155V),
(D108I_D147Y_E155V),
(D108F_D147Y_E155V),
(A106V_D108N_D147Y),
(A106V_D108M_D147Y_E155V),
(E59A_A106V_D108N_D147Y_E155V),
(E59A cat dead_A106V_D108N_D147Y_E155V),
(L84F_A106V_D108N_H123Y_D147Y_E155V_I156Y),
(L84F_A106V_D108N_H123Y_D147Y_E155V_I156F),
(D103A_D104N),
(G22P_D103A_D104N),
(D103A_D104N_S138A),
(R26G_L84F_A106V_R107H_D108N_H123Y_A142N_A143D_D147Y_E155V_I156F),
(E25G_R26G_L84F_A106V_R107H_D108N_H123Y_A142N_A143D_D147Y_E155V_I156F),
(E25D_R26G_L84F_A106V_R107K_D108N_H123Y_A142N_A143G_D147Y_E155V_I156F),
(R26Q_L84F_A106V_D108N_H123Y_A142N_D147Y_E155V_I156F),
(E25M_R26G_L84F_A106V_R107P_D108N_H123Y_A142N_A143D_D147Y_E155V_I156F),
(R26C_L84F_A106V_R107H_D108N_H123Y_A142N_D147Y_E155V_I156F),
(L84F_A106V_D108N_H123Y_A142N_A143L_D147Y_E155V_I156F),
(R26G_L84F_A106V_D108N_H123Y_A142N_D147Y_E155V_I156F),
(E25A_R26G_L84F_A106V_R107N_D108N_H123Y_A142N_A143E_D147Y_E155V_I156F), (R26G_L84F_A106V_R107H_D108N_H123Y_A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_A143G_D147Y_E155V),
(R26G_A106V_D108N_R107H_A142N_A143D_D147Y_E155V),
(E25D_R26G_A106V_D108N_A142N_D147Y_E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S146C_D147Y_E155V_I156F_K157N),
(N37T_P48T_M70L_L84F_A106V_D108N_H123Y_D147Y_I49V_E155V_I156F),
(N37S_L84F_A106V_D108N_H123Y_D147Y_E155V_I156F_K161T),
(H36L_L84F_A106V_D108N_H123Y_D147Y_Q154H_E155V_I156F),
(N72S_L84F_A106V_D108N_H123Y_S146R_D147Y_E155V_I156F),
(H36L_P48L_L84F_A106V_D108N_H123Y_E134G_D147Y_E155V_I156F),
(H36L_L84F_A106V_D108N_H123Y_D147Y_E155V_I156F_K157N),
(H36L_L84F_A106V_D108N_H123Y_S146C_D147Y_E155V_I156F),
(L84F_A106V_D108N_H123Y_S146R_D147Y_E155V_I156F_K161T),
(N37S_R51H_D77G_L84F_A106V_D108N_H123Y_D147Y_E155V_I156F),
(R51L_L84F_A106V_D108N_H123Y_D147Y_E155V_I156F_K157N),
(D24G_Q71R_L84F_H96L_A106V_D108N_H123Y_D147Y_E155V_I156F_K160E),
(H36L_G67V_L84F_A106V_D108N_H123Y_S146T_D147Y_E155V_I156F),
(Q71L_L84F_A106V_D108N_H123Y_L137M_A143E_D147Y_E155V_I156F),
(E25G_L84F_A106V_D108N_H123Y_D147Y_E155V_I156F_Q159L),
(L84F_A91T_F104I_A106V_D108N_H123Y_D147Y_E155V_I156F),
(N72D_L84F_A106V_D108N_H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_E155V_I156F),
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S146C_D147Y_E155V_I156F_K157N),
(N37S_L84F_A106V_D108N_H123Y_A142N_D147Y_E155V_I156F_K161T),
(L84F_A106V_D108N_D147Y_E155V_I156F),
(R51L_L84F_A106V_D108N_H123Y_S146C_D147Y_E155V_I156F_K157N_K161T),
(L84F_A106V_D108N_H123Y_S146C_D147Y_E155V_I156F_K161T),
(L84F_A106V_D108N_H123Y_S146C_D147Y_E155V_I156F_K157N_K160E_K161T),
(L84F_A106V_D108N_H123Y_S146C_D147Y_E155V_I156F_K157N_K160E),
(R74Q_L84F_A106V_D108N_H123Y_D147Y_E155V_I156F),
(R74A_L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F),
(L84F_R98Q_A106V_D108N_H123Y_D147Y_E155V_I156F),
(L84F_A106V_D108N_H123Y_R129Q_D147Y_E155V_I156F),
(P48S_L84F_A106V_D108N_H123Y_A142N_D147Y_E155V_I156F),
(P48S_A142N),
(P48T_I49V_L84F_A106V_D108N_H123Y_A142N_D147Y_E155V_I156F_L157N),
(P48T_I49V_A142N),
(H36L_P48S_R51L_L84F_A106V_D108N_H123Y_S146C_D147Y_E155V_I156F_K157N),
(H36L_P48S_R51L_L84F_A106V_D108N_H123Y_S146C_A142N_D147Y_E155V_I156F
(H36L_P48T_I49V_R51L_L84F_A106V_D108N_H123Y_S146C_D147Y_E155V_I156F_K157N),
(H36L_P48T_I49V_R51L_L84F_A106V_D108N_H123Y_A142N_S146C_D147Y_E155V_I156F_K157N),
(H36L_P48A_R51L_L84F_A106V_D108N_H123Y_S146C_D147Y_E155V_I156F_K157N),
(H36L_P48A_R51L_L84F_A106V_D108N_H123Y_A142N_S146C_D147Y_E155V_I156F_K157N),
(H36L_P48A_R51L_L84F_A106V_D108N_H123Y_S146C_A142N_D147Y_E155V_I156F_K157N),
(W23L_H36L_P48A_R51L_L84F_A106V_D108N_H123Y_S146C_D147Y_E155V_I156F_K157N),
(W23R_H36L_P48A_R51L_L84F_A106V_D108N_H123Y_S146C_D147Y_E155V_I156F_K157N),
(W23L_H36L_P48A_R51L_L84F_A106V_D108N_H123Y_S146R_D147Y_E155V_I156F_K161T),
(H36L_P48A_R51L_L84F_A106V_D108N_H123Y_S146C_D147Y_R152H_E155V_I156F_K157N),
(H36L_P48A_R51L_L84F_A106V_D108N_H123Y_S146C_D147Y_R152P_E155V_I156F_K157N),
(W23L_H36L_P48A_R51L_L84F_A106V_D108N_H123Y_S146C_D147Y_R152P_E155V_I156F_K157N),
(W23L_H36L_P48A_R51L_L84F_A106V_D108N_H123Y_A142A_S146C_D147Y_E155V_I156F_K157N),
(W23L_H36L_P48A_R51L_L84F_A106V_D108N_H123Y_A142A_S146C_D147Y_R152P_E155V_I156F_K157N),
(W23L_H36L_P48A_R51L_L84F_A106V_D108N_H123Y_S146R_D147Y_E155V_I156F_K161T),
(W23R_H36L_P48A_R51L_L84F_A106V_D108N_H123Y_S146C_D147Y_R152P_E155V_I156F_K157N),
(H36L_P48A_R51L_L84F_A106V_D108N_H123Y_A142N_S146C_D147Y_R152P_E155V_I156F_K157N).

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the adenosine deaminase is TadA*7.10. In some embodiments, TadA*7.10 comprises at least one alteration. In particular embodiments, TadA*7.10 comprises one or more of the following alterations: Y147T, Y147R, Q154S, Y123H, V82S, T166R, and Q154R. The alteration Y123H is also referred to herein as H123H (the alteration H123Y in TadA*7.10 reverted back to Y123H (wt)). In other embodiments, the TadA*7.10 comprises a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R. In particular embodiments, an adenosine deaminase variant comprises a deletion of the C terminus beginning at residue 149, 150, 151, 152, 153, 154, 155, 156, and 157, relative to TadA*7.10, the TadA reference sequence, or a corresponding mutation in another TadA.

In other embodiments, a base editor of the disclosure is a monomer comprising an adenosine deaminase variant (e.g., TadA*8) comprising one or more of the following alterations: Y147T, Y147R, Q154S, Y123H, V82S, T166R, and/or Q154R, relative to TadA*7.10, the TadA reference sequence, or a corresponding mutation in another TadA. In other embodiments, the adenosine deaminase variant (TadA*8) is a monomer comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA. In other embodiments, a base editor is a heterodimer comprising a wild-type adenosine deaminase and an adenosine deaminase variant (e.g., TadA*8) comprising one or more of the following alterations Y147T, Y147R, Q154S, Y123H, V82S, T166R, and/or Q154R, relative to TadA*7.10, the TadA reference sequence, or a corresponding mutation in another TadA. In other embodiments, the base editor is a heterodimer comprising a TadA*7.10 domain and an adenosine deaminase variant domain (e.g., TadA*8) comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In one embodiment, an adenosine deaminase is a TadA*8 that comprises or consists essentially of the following sequence or a fragment thereof having adenosine deaminase activity:

MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD (SEQ ID NO: 13)

In some embodiments, the TadA*8 is a truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In some embodiments the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24.

In one embodiment, a fusion protein of the disclosure comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the base editor comprises TadA*8 and TadA(wt), which are capable of forming heterodimers. Exemplary sequences follow:

```
TadA(wt) or "the TadA reference sequence":
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCT

FFRMPRQVFNAQKKAQSSTD (SEQ ID NO: 2)

TadA*7.10:
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD (SEQ ID NO: 3)

TadA*8:
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCT

FFRMPRQVFNAQKKAQSSID (SEQ ID NO: 13).
```

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In particular embodiments, a TadA*8 comprises one or more mutations at any of the following positions shown in bold. In other embodiments, a TadA*8 comprises one or more mutations at any of the positions shown with underlining:

```
MSEVEFSHEY WMRHALTLAK RARDEREVPV GAVLVLNNRV IGEGWNRAIG   50

LHDPTAHAEI MALRQGGLVM QNYRLIDATL YVTFEPCVMC AGAMIHSRIG  100

RVVFGVRNAK TGAAGSLMDV LHYPGMNHRV EITEGILADE CAALLCYFFR  150

MPRQVFNAQK KAQSSTD (SEQ ID NO: 3)
```

For example, the TadA*8 comprises alterations at amino acid position 82 and/or 166 (e.g., V82S, T166R) alone or in combination with any one or more of the following Y147T, Y147R, Q154S, Y123H, and/or Q154R, relative to TadA*7.10, the TadA reference sequence, or a corresponding mutation in another TadA. In particular embodiments, a combination of alterations are selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R, relative to TadA*7.10, the TadA reference sequence, or a corresponding mutation in another TadA.

In some embodiments, the adenosine deaminase is TadA*8, which comprises or consists essentially of the following sequence or a fragment thereof having adenosine deaminase activity:

```
MSEVEFSHEY WMRHALTLAK RARDEREVPV GAVLVLNNRV

IGEGWNRAIG LHDPTAHAEI MALRQGGLVM QNYRLIDATL

YVTFEPCVMC AGAMIHSRIG RVVFGVRNAK TGAAGSLMDV

LHYPGMNHRV EITEGILADE CAALLCTFFR MPRQVFNAQK

KAQSSTD (SEQ ID NO: 13)
```

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In one embodiment, a fusion protein of the disclosure comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the base editor comprises TadA*8 and TadA(wt), which are capable of forming heterodimers.

Cytidine Deaminases

The fusion proteins provided herein comprise one or more cytidine deaminases. In some embodiments, the cytidine deaminases provided herein are capable of deaminating cytosine or 5-methylcytosine to uracil or thymine. In some embodiments, the cytidine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

A fusion protein of the disclosure comprises two or more nucleic acid editing domains. In some embodiments, the nucleic acid editing domain can catalyze a C to U base change. In some embodiments, the nucleic acid editing domain is a deaminase domain, in particular, two deaminase domains. In some embodiments, the deaminase is a cytidine deaminase and an adenosine deaminase. In some embodiments, the deaminase is a cytidine deaminase or an adenosine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G. In some embodiments, the deaminase is a fragment of the human APOBEC3G. In some embodiments, the deaminase is a human APOBEC3G variant comprising a D316R D317R mutation. In some embodiments, the deaminase is a fragment of the human APOBEC3G and comprises mutations corresponding to the D316R D317R mutations. In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

Additional Domains

A base editor described herein can include any domain which helps to facilitate the nucleobase editing, modification or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some embodiments, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise an uracil glycosylase inhibitor (UGI) domain. In some embodiments, cellular DNA repair response to the presence of U:G heteroduplex DNA can be responsible for a decrease in nucleobase editing efficiency in cells. In such embodiments, uracil DNA glycosylase (UDG) can catalyze removal of U from DNA in cells, which can initiate base excision repair (BER), mostly resulting in reversion of the U:G pair to a C:G pair. In such embodiments, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB) binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

Additionally, in some embodiments, a Gam protein can be fused to an N terminus of a base editor. In some embodiments, a Gam protein can be fused to a C-terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some embodiments, a mutation or mutations can change the length of a base editor domain relative to a wild-type domain. For example, a deletion of at least one amino acid in at least one domain can reduce the length of the base editor. In another case, a mutation or mutations do not change the length of a domain relative to a wild-type domain. For example, substitution(s) in any domain does/do not change the length of the base editor.

In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some embodiments, a NAP or portion thereof incorporated into a base editor is a translesion DNA polymerase. In some embodiments, a NAP or portion thereof incorporated into a base editor is a Rev7, Rev1 complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase).

Other Nucleobase Editors

The disclosure provides for a modular multi-effector nucleobase editor wherein virtually any nucleobase editor known in the art can be inserted into the fusion protein described herein or swapped in for a cytidine deaminase or adenosine deaminase. In one embodiment, the disclosure features a multi-effector nucleobase editor comprising an abasic nucleobase editor domain. Abasic nucleobase editors are known in the art and described, for example, by Kavli et al., EMBO J. 15:3442-3447, 1996, which is incorporated herein by reference.

In one embodiment, a multi-effector nucleobase editor comprises the following domains A-C, A-D, or A-E:
  NH$_2$-[A-B-C]-COOH,
  NH$_2$-[A-B-C-D]-COOH, or
  NH$_2$-[A-B-C-D-E]-COOH
wherein A and C or A, C, and E, each comprises one or more of the following: an adenosine deaminase domain or an active fragment thereof, a cytidine deaminase domain or an active fragment thereof, a DNA glycosylase domain or an active fragment thereof; and where B or B and D, each comprises one or more domains having nucleic acid sequence specific binding activity.

In one embodiment, a multi-effector nucleobase editor comprises NH$_2$-[A$_n$-B$_o$-C$_n$]-COOH,
  NH$_2$-[A$_n$-B$_o$-C$_n$-D$_o$]-COOH, or
  NH$_2$-[A$_n$-B$_o$-C$_p$-D$_o$-Eq]-COOH;
wherein A and C or A, C, and E, each comprises one or more of the following: an adenosine deaminase domain or an active fragment thereof, a cytidine deaminase domain or an active fragment thereof, and a DNA glycosylase domain or an active fragment thereof; and where n is an integer: 1, 2, 3, 4, or 5, and where p is an integer: 0, 1, 2, 3, 4, or 5; and B or B and D each comprises a domain having nucleic acid sequence specific binding activity; and wherein o is an integer: 1, 2, 3, 4, or 5.

Base Editor System

Use of the base editor system provided herein comprises the steps of: (a) contacting a target nucleotide sequence of a polynucleotide (e.g., double- or single stranded DNA or RNA) of a subject with a base editor system comprising a nucleobase editor (e.g., an adenosine base editor) and a guide polynucleic acid (e.g., gRNA), wherein the target nucleotide sequence comprises a targeted nucleobase pair; (b) inducing strand separation of said target region; (c) converting a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase. It should be appreciated that in some embodiments, step (b) is omitted. In some embodiments, said targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

Base editing system as provided herein provides a new approach to genome editing that uses a fusion protein containing a catalytically defective *Streptococcus pyogenes* Cas9, an adenosine deaminase, and an inhibitor of base excision repair to induce programmable, single nucleotide (C→T or A→G) changes in DNA without generating double-strand DNA breaks, without requiring a donor DNA template, and without inducing an excess of stochastic insertions and deletions.

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain (FIG. 2A). In some embodiments, the base editor system comprises an adenosine base editor (ABE). In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the nucleobase editing domain is a deaminase domain. In some embodiments, a deaminase domain can be an adenine deaminase or an adenosine deaminase. In some embodiments, the adenosine base editor can deaminate adenine in DNA. In some embodiments, ABE comprises an evolved TadA variant.

Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, a single guide polynucleotide may be utilized to target a deaminase to a target nucleic acid sequence. In some embodiments, a single pair of guide polynucleotides may be utilized to target different deaminases to a target nucleic acid sequence.

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, the base editor inhibits base excision repair (BER) of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the base editing fusion proteins provided herein need to be positioned at a precise location, for example, where a target base is placed within a defined region (e.g., a "deamination window"). In some embodiments, a target can be within a 4 base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide programmable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Non-limiting examples of protein domains which can be included in the fusion protein include deaminase domains (e.g., adenosine deaminase), a uracil glycosylase inhibitor (UGI) domain, epitope tags, and reporter gene sequences.

Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including, but not limited to, maltose binding protein (MBP), S-tag, Lex A DNA binding domain (DBD) fusions, GAL4 DNA binding domain fusions, and herpes simplex virus (HSV) BP16 protein fusions.

In some embodiments, the adenosine base editor (ABE) can deaminate adenine in DNA. In some embodiments, ABE is generated by replacing APOBEC1 component of BE3 with natural or engineered E. coli TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second-generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of E. coli Endo V (inactivated with D35A mutation). In some embodiments, the ABE is ABE2.6 which has a linker twice as long (32 amino acids, (SGGS)$_2$-XTEN-(SGGS)$_2$ ("(SGGS)$_2$" disclosed as SEQ ID NO: 163)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild-type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and I156F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type *E. coli* TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in below Table 6. In some embodiments, the ABE is a sixth generation ABE. In some embodiments, the ABE is ABE6.1, ABE6.2, ABE6.3, ABE6.4, ABE6.5, or ABE6.6, as shown in below Table 6. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE 7.9, or ABE7.10, as shown in Table 6 below.

TABLE 6

Genotypes of ABEs

| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | Y | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | I | N | K |
| ABE5.4 | W | R | H | S | P | | R | N | F | S | V | N | Y | G | A | S | Y | R | V | F | K | T |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | C | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | N | T | V | L | N | F | S | V | N | Y | G | N | S | Y | R | V | F | N | K |
| ABE6.3 | W | R | L | N | S | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | I | V | L | N | F | S | V | N | Y | G | A | C | Y | R | V | F | N | K |
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | I | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | I | N | K |
| ABE7.7 | L | R | L | N | A | | L | N | F | S | V | N | Y | G | A | C | Y | P | V | F | N | K |
| ABE7.8 | I | R | L | N | A | | L | N | F | S | V | N | Y | G | N | C | Y | R | V | F | N | K |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, the base editor is an eighth generation ABE (ABE8). In some embodiments, the ABE8 contains a TadA*8 variant. In some embodiments, the ABE8 has a monomeric construct containing a TadA*8 variant ("ABE8.x-m"). In some embodiments, the ABE8 is ABE8.1-m, which has a monomeric construct containing TadA*7.10 with a Y147T mutation (TadA*8.1). In some embodiments, the ABE8 is ABE8.2-m, which has a monomeric construct containing TadA*7.10 with a Y147R mutation (TadA*8.2). In some embodiments, the ABE8 is ABE8.3-m, which has a monomeric construct containing TadA*7.10 with a Q154S mutation (TadA*8.3). In some embodiments, the ABE8 is ABE8.4-m, which has a monomeric construct containing TadA*7.10 with a Y123H mutation (TadA*8.4). In some embodiments, the ABE8 is ABE8.5-m, which has a monomeric construct containing TadA*7.10 with a V82S mutation (TadA*8.5). In some embodiments, the ABE8 is ABE8.6-m, which has a monomeric construct containing TadA*7.10 with a T166R mutation (TadA*8.6). In some embodiments, the ABE8 is ABE8.7-m, which has a monomeric construct containing TadA*7.10 with a Q154R mutation (TadA*8.7). In some embodiments, the ABE8 is ABE8.8-m, which has a monomeric construct containing TadA*7.10 with Y147R, Q154R, and Y123H mutations (TadA*8.8). In some embodiments, the ABE8 is ABE8.9-m, which has a monomeric construct containing TadA*7.10 with Y147R, Q154R and I76Y mutations (TadA*8.9). In some embodiments, the ABE8 is ABE8.10-m, which has a monomeric construct containing TadA*7.10 with Y147R, Q154R, and T166R mutations (TadA*8.10). In some embodiments, the ABE8 is ABE8.11-m, which has a monomeric construct containing TadA*7.10 with Y147T and Q154R mutations (TadA*8.11). In some embodiments, the ABE8 is ABE8.12-m, which has a monomeric construct containing TadA*7.10 with Y147T and Q154S mutations (TadA*8.12). In some embodiments, the ABE8 is ABE8.13-m, which has a monomeric construct containing TadA*7.10 with Y123H (Y123H reverted from H123Y), Y147R, Q154R and I76Y mutations (TadA*8.13). In some embodiments, the ABE8 is ABE8.14-m, which has a monomeric construct containing TadA*7.10 with I76Y and V82S mutations (TadA*8.14). In some embodiments, the ABE8 is ABE8.15-m, which has a monomeric construct containing TadA*7.10 with V82S and Y147R mutations (TadA*8.15). In some embodiments, the ABE8 is ABE8.16-m, which has a monomeric construct containing TadA*7.10 with V82S, Y123H (Y123H reverted from H123Y) and Y147R mutations (TadA*8.16). In some embodiments, the ABE8 is ABE8.17-m, which has a monomeric construct containing TadA*7.10 with V82S and Q154R mutations (TadA*8.17). In some embodiments, the ABE8 is ABE8.18-m, which has a monomeric construct containing TadA*7.10 with V82S, Y123H (Y123H reverted from H123Y) and Q154R mutations (TadA*8.18). In some embodiments, the ABE8 is ABE8.19-m, which has a monomeric construct containing TadA*7.10 with V82S, Y123H (Y123H reverted from H123Y), Y147R and Q154R mutations (TadA*8.19). In some embodiments, the ABE8 is ABE8.20-m, which has a monomeric construct containing TadA*7.10 with I76Y, V82S, Y123H (Y123H reverted from H123Y), Y147R and Q154R mutations (TadA*8.20). In some embodiments, the ABE8 is ABE8.21-m, which has a monomeric construct containing TadA*7.10 with Y147R and Q154S mutations (TadA*8.21). In some embodiments, the ABE8 is ABE8.22-m, which has a monomeric construct containing TadA*7.10 with V82S and Q154S mutations (TadA*8.22). In some embodiments, the ABE8 is ABE8.23-m, which has a monomeric construct containing TadA*7.10 with V82S and Y123H (Y123H reverted from H123Y) mutations (TadA*8.23). In some embodiments, the ABE8 is ABE8.24-m, which has a monomeric construct containing TadA*7.10 with V82S, Y123H (Y123H reverted from H123Y), and Y147T mutations (TadA*8.24).

In some embodiments, the ABE8 has a heterodimeric construct containing wild-type E. coli TadA fused to a TadA*8 variant ("ABE8.x-d"). In some embodiments, the ABE8 is ABE8.1-d, which has a heterodimeric construct containing wild-type E. coli TadA fused to TadA*7.10 with a Y147T mutation (TadA*8.1). In some embodiments, the ABE8 is ABE8.2-d, which has a heterodimeric construct containing wild-type E. coli TadA fused to TadA*7.10 with a Y147R mutation (TadA*8.2). In some embodiments, the ABE8 is ABE8.3-d, which has a heterodimeric construct containing wild-type E. coli TadA fused to TadA*7.10 with a Q154S mutation (TadA*8.3). In some embodiments, the ABE8 is ABE8.4-d, which has a heterodimeric construct containing wild-type E. coli TadA fused to TadA*7.10 with a Y123H mutation (TadA*8.4). In some embodiments, the ABE8 is ABE8.5-d, which has a heterodimeric construct containing wild-type E. coli TadA fused to TadA*7.10 with a V82S mutation (TadA*8.5). In some embodiments, the ABE8 is ABE8.6-d, which has a heterodimeric construct containing wild-type E. coli TadA fused to TadA*7.10 with a T166R mutation (TadA*8.6). In some embodiments, the ABE8 is ABE8.7-d, which has a heterodimeric construct containing wild-type E. coli TadA fused to TadA*7.10 with a Q154R mutation (TadA*8.7). In some embodiments, the ABE8 is ABE8.8-d, which has a heterodimeric construct containing wild-type E. coli TadA fused to TadA*7.10 with Y147R, Q154R, and Y123H mutations (TadA*8.8). In some embodiments, the ABE8 is ABE8.9-d, which has a heterodimeric construct containing wild-type E. coli TadA fused to TadA*7.10 with Y147R, Q154R and I76Y mutations (TadA*8.9). In some embodiments, the ABE8 is ABE8.10-d, which has a heterodimeric construct containing wild-type E. coli TadA fused to TadA*7.10 with Y147R, Q154R, and T166R mutations (TadA*8.10). In some embodiments, the ABE8 is ABE8.11-d, which has a heterodimeric construct containing wild-type E. coli TadA fused to TadA*7.10 with Y147T and Q154R mutations (TadA*8.11). In some embodiments, the ABE8 is ABE8.12-d, which has heterodimeric construct containing wild-type E. coli TadA fused to TadA*7.10 with Y147T and Q154S mutations (TadA*8.12). In some embodiments, the ABE8 is ABE8.13-d, which has a heterodimeric construct containing wild-type E. coli TadA fused to TadA*7.10 with Y123H (Y123H reverted from H123Y), Y147R, Q154R and I76Y mutations (TadA*8.13). In some embodiments, the ABE8 is ABE8.14-d, which has a heterodimeric construct containing wild-type E. coli TadA fused to TadA*7.10 with I76Y and V82S mutations (TadA*8.14). In some embodiments, the ABE8 is ABE8.15-d, which has a heterodimeric construct containing wild-type E. coli TadA fused to TadA*7.10 with V82S and Y147R mutations (TadA*8.15). In some embodiments, the ABE8 is ABE8.16-d, which has a heterodimeric construct containing wild-type E. coli TadA fused to TadA*7.10 with V82S, Y123H (Y123H reverted from H123Y) and Y147R mutations (TadA*8.16). In some embodiments, the ABE8 is ABE8.17-d, which has a heterodimeric construct containing wild-type E. coli TadA fused to TadA*7.10 with V82S and Q154R mutations (TadA*8.17). In some embodiments, the ABE8 is ABE8.18-d, which has a heterodimeric construct containing wild-type E. coli TadA fused to TadA*7.10 with V82S, Y123H (Y123H reverted from H123Y) and Q154R mutations (TadA*8.18). In some embodiments, the ABE8 is ABE8.19-d, which has a heterodimeric construct containing wild-type *E. coli* TadA fused to TadA*7.10 with V82S, Y123H (Y123H reverted from H123Y), Y147R and Q154R mutations (TadA*8.19). In some embodiments, the ABE8 is ABE8.20-d, which has a heterodimeric construct containing wild-type *E. coli* TadA fused to TadA*7.10 with I76Y, V82S, Y123H (Y123H reverted from H123Y), Y147R and Q154R mutations (TadA*8.20). In some embodiments, the ABE8 is ABE8.21-d, which has a heterodimeric construct containing wild-type *E. coli* TadA fused to TadA*7.10 with Y147R and Q154S mutations (TadA*8.21). In some embodiments, the ABE8 is ABE8.22-d, which has a heterodimeric construct containing wild-type *E. coli* TadA fused to TadA*7.10 with V82S and Q154S mutations (TadA*8.22). In some embodiments, the ABE8 is ABE8.23-d, which has a heterodimeric construct containing wild-type *E. coli* TadA fused to TadA*7.10 with V82S and Y123H (Y123H reverted from H123Y) mutations (TadA*8.23). In some embodiments, the ABE8 is ABE8.24-d, which has a heterodimeric construct containing wild-type *E. coli* TadA fused to TadA*7.10 with V82S, Y123H (Y123H reverted from H123Y), and Y147T mutations (TadA*8.24).

In some embodiments, the ABE8 has a heterodimeric construct containing TadA*7.10 fused to a TadA*8 variant ("ABE8.x-7"). In some embodiments, the ABE8 is ABE8.1-7, which has a heterodimeric construct containing TadA*7.10 fused to TadA*7.10 with a Y147T mutation (TadA*8.1). In some embodiments, the ABE8 is ABE8.2-7, which has a heterodimeric construct containing TadA*7.10 fused to TadA*7.10 with a Y147R mutation (TadA*8.2). In some embodiments, the ABE8 is ABE8.3-7, which has a heterodimeric construct containing TadA*7.10 fused to TadA*7.10 with a Q154S mutation (TadA*8.3). In some embodiments, the ABE8 is ABE8.4-7, which has a heterodimeric construct containing TadA*7.10 fused to TadA*7.10 with a Y123H mutation (TadA*8.4). In some embodiments, the ABE8 is ABE8.5-7, which has a heterodimeric construct containing TadA*7.10 fused to TadA*7.10 with a V82S mutation (TadA*8.5). In some embodiments, the ABE8 is ABE8.6-7, which has a heterodimeric construct containing TadA*7.10 fused to TadA*7.10 with a T166R mutation (TadA*8.6). In some embodiments, the ABE8 is ABE8.7-7, which has a heterodimeric construct containing TadA*7.10 fused to TadA*7.10 with a Q154R mutation (TadA*8.7). In some embodiments, the ABE8 is ABE8.8-7, which has a heterodimeric construct containing TadA*7.10 fused to TadA*7.10 with Y147R, Q154R, and Y123H mutations (TadA*8.8). In some embodiments, the ABE8 is ABE8.9-7, which has a heterodimeric construct containing TadA*7.10 fused to TadA*7.10 with Y147R, Q154R and I76Y mutations (TadA*8.9). In some embodiments, the ABE8 is ABE8.10-7, which has a heterodimeric construct containing TadA*7.10 fused to TadA*7.10 with Y147R, Q154R, and T166R mutations (TadA*8.10). In some embodiments, the ABE8 is ABE8.11-7, which has a heterodimeric construct containing TadA*7.10 fused to TadA*7.10 with Y147T and Q154R mutations (TadA*8.11). In some embodiments, the ABE8 is ABE8.12-7, which has a heterodimeric construct containing TadA*7.10 fused to TadA*7.10 with Y147T and Q154S mutations (TadA*8.12). In some embodiments, the ABE8 is ABE8.13-7, which has a heterodimeric construct containing TadA*7.10 fused to TadA*7.10 with Y123H (Y123H reverted from H123Y), Y147R, Q154R and I76Y mutations (TadA*8.13). In some embodiments, the ABE8 is ABE8.14-7, which has a heterodimeric construct containing TadA*7.10 fused to TadA*7.10 with I76Y and V82S mutations (TadA*8.14). In some embodiments, the ABE8 is ABE8.15-7, which has a heterodimeric construct containing TadA*7.10 fused to TadA*7.10 with V82S and Y147R mutations (TadA*8.15). In some embodiments, the ABE8 is ABE8.16-7, which has a heterodimeric construct containing TadA*7.10 fused to TadA*7.10 with V82S, Y123H (Y123H reverted from H123Y) and Y147R mutations (TadA*8.16). In some embodiments, the ABE8 is ABE8.17-7, which has a heterodimeric construct containing TadA*7.10 fused to TadA*7.10 with V82S and Q154R mutations (TadA*8.17). In some embodiments, the ABE8 is ABE8.18-7, which has a heterodimeric construct containing TadA*7.10 fused to TadA*7.10 with V82S, Y123H (Y123H reverted from H123Y) and Q154R mutations (TadA*8.18). In some embodiments, the ABE8 is ABE8.19-7, which has a heterodimeric construct containing TadA*7.10 fused to TadA*7.10 with V82S, Y123H (Y123H reverted from H123Y), Y147R and Q154R mutations (TadA*8.19). In some embodiments, the ABE8 is ABE8.20-7, which has a heterodimeric construct containing TadA*7.10 fused to TadA*7.10 with I76Y, V82S, Y123H (Y123H reverted from H123Y), Y147R and Q154R mutations (TadA*8.20). In some embodiments, the ABE8 is ABE8.21-7, which has a heterodimeric construct containing TadA*7.10 fused to TadA*7.10 with Y147R and Q154S mutations (TadA*8.21). In some embodiments, the ABE8 is ABE8.22-7, which has a heterodimeric construct containing TadA*7.10 fused to TadA*7.10 with V82S and Q154S mutations (TadA*8.22). In some embodiments, the ABE8 is ABE8.23-7, which has a heterodimeric construct containing TadA*7.10 fused to TadA*7.10 with V82S and Y123H (Y123H reverted from H123Y) mutations (TadA*8.23). In some embodiments, the ABE8 is ABE8.24-7, which has a heterodimeric construct containing TadA*7.10 fused to TadA*7.10 with V82S, Y123H (Y123H reverted from H123Y), and Y147T mutations (TadA*8.24

In some embodiments, the ABE is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m, ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d as shown in Table 7 below.

TABLE 7

Adenosine Deaminase Base Editor 8 Variants

| ABE8 | Adenosine Deaminase | Adenosine Deaminase Description |
|---|---|---|
| ABE8.1-m | TadA*8.1 | Monomer_TadA*7.10 + Y147T |
| ABE8.2-m | TadA*8.2 | Monomer_TadA*7.10 + Y147R |

TABLE 7-continued

Adenosine Deaminase Base Editor 8 Variants

| ABE8 | Adenosine Deaminase | Adenosine Deaminase Description |
|---|---|---|
| ABE8.3-m | TadA*8.3 | Monomer_TadA*7.10 + Q154S |
| ABE8.4-m | TadA*8.4 | Monomer_TadA*7.10 + Y123H |
| ABE8.5-m | TadA*8.5 | Monomer_TadA*7.10 + V82S |
| ABE8.6-m | TadA*8.6 | Monomer_TadA*7.10 + T166R |
| ABE8.7-m | TadA*8.7 | Monomer_TadA*7.10 + Q154R |
| ABE8.8-m | TadA*8.8 | Monomer_TadA*7.10 + Y147R_Q154R_Y123H |
| ABE8.9-m | TadA*8.9 | Monomer_TadA*7.10 + Y147R_Q154R_I76Y |
| ABE8.10-m | TadA*8.10 | Monomer_TadA*7.10 + Y147R_Q154R_T166R |
| ABE8.11-m | TadA*8.11 | Monomer_TadA*7.10 + Y147T_Q154R |
| ABE8.12-m | TadA*8.12 | Monomer_TadA*7.10 + Y147T_Q154S |
| ABE8.13-m | TadA*8.13 | Monomer_TadA*7.10 + Y123H_Y147R_Q154R_I76Y |
| ABE8.14-m | TadA*8.14 | Monomer_TadA*7.10 + I76Y_V82S |
| ABE8.15-m | TadA*8.15 | Monomer_TadA*7.10 + V82S_Y147R |
| ABE8.16-m | TadA*8.16 | Monomer_TadA*7.10 + V82S_Y123H_Y147R |
| ABE8.17-m | TadA*8.17 | Monomer_TadA*7.10 + V82S_Q154R |
| ABE8.18-m | TadA*8.18 | Monomer_TadA*7.10 + V82S_Y123H_Q154R |
| ABE8.19-m | TadA*8.19 | Monomer_TadA*7.10 + V82S_Y123H_Y147R_Q154R |
| ABE8.20-m | TadA*8.20 | Monomer_TadA*7.10 + I76Y_V82S_Y123H_Y147R_Q154R |
| ABE8.21-m | TadA*8.21 | Monomer_TadA*7.10 + Y147R_Q154S |
| ABE8.22-m | TadA*8.22 | Monomer_TadA*7.10 + V82S_Q154S |
| ABE8.23-m | TadA*8.23 | Monomer_TadA*7.10 + V82S_Y123H |
| ABE8.24-m | TadA*8.24 | Monomer_TadA*7.10 + V82S_Y123H_Y147T |
| ABE8.1-d | TadA*8.1 | Heterodimer_(WT) + (TadA*7.10 + Y147T) |
| ABE8.2-d | TadA*8.2 | Heterodimer_(WT) + (TadA*7.10 + Y147R) |
| ABE8.3-d | TadA*8.3 | Heterodimer_(WT) + (TadA*7.10 + Q154S) |
| ABE8.4-d | TadA*8.4 | Heterodimer_(WT) + (TadA*7.10 + Y123H) |
| ABE8.5-d | TadA*8.5 | Heterodimer_(WT) + (TadA*7.10 + V82S) |
| ABE8.6-d | TadA*8.6 | Heterodimer_(WT) + (TadA*7.10 + T166R) |
| ABE8.7-d | TadA*8.7 | Heterodimer_(WT) + (TadA*7.10 + Q154R) |
| ABE8.8-d | TadA*8.8 | Heterodimer_(WT) + (TadA*7.10 + Y147R_Q154R_Y123H) |
| ABE8.9-d | TadA*8.9 | Heterodimer_(WT) + (TadA*7.10 + Y147R_Q154R_I76Y) |
| ABE8.10-d | TadA*8.10 | Heterodimer_(WT) + (TadA*7.10 + Y147R_Q154R_T166R) |
| ABE8.11-d | TadA*8.11 | Heterodimer_(WT) + (TadA*7.10 + Y147T_Q154R) |
| ABE8.12-d | TadA*8.12 | Heterodimer_(WT) + (TadA*7.10 + Y147T_Q154S) |
| ABE8.13-d | TadA*8.13 | Heterodimer_(WT) + (TadA*7.10 + Y123H_Y147T_Q154R_I76Y) |
| ABE8.14-d | TadA*8.14 | Heterodimer_(WT) + (TadA*7.10 + I76Y_V82S) |
| ABE8.15-d | TadA*8.15 | Heterodimer_(WT) + (TadA*7.10 + V82S_Y147R) |
| ABE8.16-d | TadA*8.16 | Heterodimer_(WT) + (TadA*7.10 + V82S_Y123H_Y147R) |
| ABE8.17-d | TadA*8.17 | Heterodimer_(WT) + (TadA*7.10 + V82S_Q154R) |
| ABE8.18-d | TadA*8.18 | Heterodimer_(WT) + (TadA*7.10 + V82S_Y123H_Q154R) |
| ABE8.19-d | TadA*8.19 | Heterodimer_(WT) + (TadA*7.10 + V82S_Y123H_Y147R_Q154R) |
| ABE8.20-d | TadA*8.20 | Heterodimer_(WT) + (TadA*7.10 + I76Y_V82S_Y123H_Y147R_Q154R) |
| ABE8.21-d | TadA*8.21 | Heterodimer_(WT) + (TadA*7.10 + Y147R_Q154S) |
| ABE8.22-d | TadA*8.22 | Heterodimer_(WT) + (TadA*7.10 + V82S_Q154S) |
| ABE8.23-d | TadA*8.23 | Heterodimer_(WT) + (TadA*7.10 + V82S_Y123H) |
| ABE8.24-d | TadA*8.24 | Heterodimer_(WT) + (TadA*7.10 + V82S_Y123H_Y147T) |

In some embodiments, base editors (e.g., ABE8) are generated by cloning an adenosine deaminase variant (e.g., TadA*8) into a scaffold that includes a circular permutant Cas9 (e.g., CP5 or CP6) and a bipartite nuclear localization sequence. In some embodiments, the base editor (e.g., ABE7.9, ABE7.10, or ABE8) is an NGC PAM CP5 variant (S. pyrogenes Cas9 or spVRQR Cas9). In some embodiments, the base editor (e.g., ABE7.9, ABE7.10, or ABE8) is an AGA PAM CP5 variant (S. pyrogenes Cas9 or spVRQR Cas9). In some embodiments, the base editor (e.g., ABE7.9, ABE7.10, or ABE8) is an NGC PAM CP6 variant (S. pyrogenes Cas9 or spVRQR Cas9). In some embodiments, the base editor (e.g. ABE7.9, ABE7.10, or ABE8) is an AGA PAM CP6 variant (S. pyrogenes Cas9 or spVRQR Cas9).

In some embodiments, the ABE has a genotype as shown in Table 8 below.

TABLE 8

Genotypes of ABEs

| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

As shown in Table 9 below, genotypes of 40 ABE8s are described. Residue positions in the evolved E. coli TadA portion of ABE are indicated. Mutational changes in ABE8 are shown when distinct from ABE7.10 mutations. In some embodiments, the ABE has a genotype of one of the ABEs as shown in Table 9 below.

TABLE 9

| | \multicolumn{18}{c}{Residue Identity in Evolved TadA} |
|---|---|---|---|---|---|---|---|---|---|---|---|---|---|---|---|---|---|---|
| | 23 | 36 | 48 | 51 | 76 | 82 | 84 | 106 | 108 | 123 | 146 | 147 | 152 | 154 | 155 | 156 | 157 | 166 |
| ABE7.10 | R | L | A | L | I | V | F | V | N | Y | C | Y | P | Q | V | F | N | T |
| ABE8.1-m | | | | | | | | | | | | T | | | | | | |
| ABE8.2-m | | | | | | | | | | | | R | | | | | | |
| ABE8.3-m | | | | | | | | | | | | | | S | | | | |
| ABE8.4-m | | | | | | | | | | H | | | | | | | | |
| ABE8.5-m | | | | | | S | | | | | | | | | | | | |
| ABE8.6-m | | | | | | | | | | | | | | | | | | R |
| ABE8.7-m | | | | | | | | | | | | | | R | | | | |
| ABE8.8-m | | | | | | | | | | H | | R | | R | | | | |
| ABE8.9-m | | | | | Y | | | | | | | R | | R | | | | |
| ABE8.10-m | | | | | | | | | | | | R | | R | | | R | |
| ABE8.11-m | | | | | | | | | | | | T | | R | | | | |
| ABE8.12-m | | | | | | | | | | | | T | | S | | | | |
| ABE8.13-m | | | | | Y | | | | | H | | R | | R | | | | |
| ABE8.14-m | | | | | Y | S | | | | | | | | | | | | |
| ABE8.15-m | | | | | | S | | | | | | R | | | | | | |
| ABE8.16-m | | | | | | S | | | | H | | R | | | | | | |
| ABE8.17-m | | | | | | S | | | | | | | | R | | | | |
| ABE8.18-m | | | | | | S | | | | H | | | | R | | | | |
| ABE8.19-m | | | | | | S | | | | H | | R | | R | | | | |
| ABE8.20-m | | | | | Y | S | | | | H | | R | | R | | | | |
| ABE8.21-m | | | | | | | | | | | | R | | S | | | | |
| ABE8.22-m | | | | | | S | | | | | | | | S | | | | |
| ABE8.23-m | | | | | | S | | | | H | | | | | | | | |
| ABE8.24-m | | | | | | S | | | | H | | T | | | | | | |
| ABE8.1-d | | | | | | | | | | | | T | | | | | | |
| ABE8.2-d | | | | | | | | | | | | R | | | | | | |
| ABE8.3-d | | | | | | | | | | | | | | S | | | | |
| ABE8.4-d | | | | | | | | | | H | | | | | | | | |
| ABE8.5-d | | | | | | S | | | | | | | | | | | | |
| ABE8.6-d | | | | | | | | | | | | | | | | | | R |
| ABE8.7-d | | | | | | | | | | | | | | R | | | | |
| ABE8.8-d | | | | | | | | | | H | | R | | R | | | | |
| ABE8.9-d | | | | | Y | | | | | | | R | | R | | | | |
| ABE8.10-d | | | | | | | | | | | | R | | R | | | R | |
| ABE8.11-d | | | | | | | | | | | | T | | R | | | | |
| ABE8.12-d | | | | | | | | | | | | T | | S | | | | |
| ABE8.13-d | | | | | Y | | | | | H | | R | | R | | | | |
| ABE8.14-d | | | | | Y | S | | | | | | | | | | | | |
| ABE8.15-d | | | | | | S | | | | | | R | | | | | | |
| ABE8.16-d | | | | | | S | | | | H | | R | | | | | | |
| ABE8.17-d | | | | | | S | | | | | | | | R | | | | |
| ABE8.18-d | | | | | | S | | | | H | | | | R | | | | |
| ABE8.19-d | | | | | | S | | | | H | | R | | R | | | | |
| ABE8.20-d | | | | | Y | S | | | | H | | R | | R | | | | |
| ABE8.21-d | | | | | | | | | | | | R | | S | | | | |
| ABE8.22-d | | | | | | S | | | | | | | | S | | | | |
| ABE8.23-d | | | | | | S | | | | H | | | | | | | | |
| ABE8.24-d | | | | | | S | | | | H | | T | | | | | | |

In some embodiments, the base editor is ABE8.1, which comprises or consists essentially of the following sequence or a fragment thereof having adenosine deaminase activity:

ABE8.1_Y147T_CP5_NGC PAM_monomer
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRQVFNAQKKAQSSTDSGGSSGGSSGSETPGTSES

ATPESSGGSSGGSEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFMQPT

VAYSVLVVAKVEKGKSKKLKSVKELLGITIMERSSFEKNPIDFLEAKGYKEVKKDLIIKLPK

YSLFELENGRKRMLASAKFLQKGNELALPSKYVNFLYLASHYEKLKGSPEDNEQKQLFVEQH

KHYLDEIIEQISEFSKRVILADANLDKVLSAYNKHRDKPIREQAENIIHLFTLTNLGAPRAF

```
KYFDTTIARKEYRSTKEVLDATLIHQSITGLYETRIDLSQLGGDGGSGGSGGSGGSGGSGGS

GGMDKKYSIGLAIGTNSVGWAVITDEYKVPSKKFKVLGNTDRHSIKKNLIGALLFDSGETAE

ATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKL

FIQLVQTYNQLFEENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKNLSDAILLSDILRV

NTEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIER

MTNFDKNLPNEKVLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVK

VVDELVKVMGRHKPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREINNYHHAHDAYLN

AVVGTALIKKYPKLESEFVYGDYKVYDVRKMIAKSEQEGADKRTADGSEFESPKKKRKV*
(SEQ ID NO: 164)
```

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.1, which comprises or consists essentially of the following sequence or a fragment thereof having adenosine deaminase activity:

```
pNMG-B335_ABE8.1_Y147T_CP5_NGC_PAM_monomer
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRQVFNAQKKAQSSTDSGGSSGGSSGSETPGTSES

ATPESSGGSSGGSEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFMQPT

VAYSVLVVAKVEKGKSKKLKSVKELLGITIMERSSFEKNPIDFLEAKGYKEVKKDLIIKLPK

YSLFELENGRKRMLASAKFLQKGNELALPSKYVNFLYLASHYEKLKGSPEDNEQKQLFVEQH

KHYLDEIIEQISEFSKRVILADANLDKVLSAYNKHRDKPIREQAENIIHLFTLTNLGAPRAF

KYFDTTIARKEYRSTKEVLDATLIHQSITGLYETRIDLSQLGGDGGSGGSGGSGGSGGSGGS

GGMDKKYSIGLAIGTNSVGWAVITDEYKVPSKKFKVLGNTDRHSIKKNLIGALLFDSGETAE

ATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKL

FIQLVQTYNQLFEENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKNLSDAILLSDILRV

NTEITKAPLSASMIKRYDEHHQDLTLLKALVRQQLPEKYKEIFFDQSKNGYAGYIDGGASQE
```

-continued

EFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIER

MTNFDKNLPNEKVLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANLAGSPAIKKGILQTVK

VVDELVKVMGRHKPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREINNYHHAHDAYLN

AVVGTALIKKYPKLESEFVYGDYKVYDVRKMIAKSEQ*EGADKRTADGSEFESPKKKRKV*
(SEQ ID NO: 164)

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.14, which comprises or consists essentially of the following sequence or a fragment thereof having adenosine deaminase activity:

pNMG-357_ABE8.14 with NGC PAM CP5
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDGGSSGGS*SGSETPGTSESA*

*TPESSGGSSGGS*MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCTFFRMPRQVFNAQKKAQSSTD*SGGSSGG*

*SSSGSETPGTSESATPESSGGSSGGS*EIGKATAKYFFYSNIMNFFKTEITLANGEIRKRPLIE

TNGETGEIVWDKGRDFATVRKVLSMPQVNIVKKTEVQTGGFSKESILPKRNSDKLIARKKDW

DPKKYGGFMQPTVAYSVLVVAKVEKGKSKKLKSVKELLGITIMERSSFEKNPIDFLEAKGYK

EVKKDLIIKLPKYSLFELENGRKRMLASAKFLQKGNELALPSKYVNFLYLASHYEKLKGSPE

DNEQKQLFVEQHKHYLDEIIEQISEFSKRVILADANLDKVLSAYNKHRDKPIREQAENIIHL

FTLTNLGAPRAFKYFDTTIARKEYRSTKEVLDATLIHQSITGLYETRIDLSQLGGD*GGSGGS*

*GGSGGSGGSGGSGGM*DKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEED

KKHERHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLPGEKK

NGLFGNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSKNG

YAGYIDGGASQEEFYKFIKPILEKMDGTEELLVKLNREDLLRKQRTFDNGSIPHQIHLGELH

AILRRQEDFYPFLKDNREKIEKILTFRIPYYVGPLARGNSRFAWMTRKSEETITPWNFEEVV

DKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDF

-continued

LDNEENEDILEDIVLTLTLFEDREMIEERLKTYAHLFDDKVMKQLKRRRYTGWGRLSRKLIN

GIRDKQSGKTILDFLKSDGFANRNFMQLIHDDSLTFKEDIQKAQVSGQGDSLHEHIANLAGS

PAIKKGILQTVKVVDELVKVMGRHKPENIVIEMARENQTTQKGQKNSRERMKRIEEGIKELG

SQILKEHPVENTQLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAERGGLSELDKAGF

IKRQLVETRQITKHVAQILDSRMNTKYDENDKLIREVKVITLKSKLVSDFRKDFQFYKVREI

NNYHHAHDAYLNAVVGTALIKKYPKLESEFVYGDYKVYDVRKMIAKSEQ

EGADKRTADGSEFESPKKKRKV* (SEQ ID NO: 165)

In the above sequence, the plain text denotes an adenosine deaminase sequence, bold sequence indicates sequence derived from Cas9, the italicized sequence denotes a linker sequence, and the underlined sequence denotes a bipartite nuclear localization sequence.

In some embodiments, the base editor is ABE8.8-m, which comprises or consists essentially of the following sequence or a fragment thereof having adenosine deaminase activity.

ABE8.8-m
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHHP

GMNHRVEITEGILADECAALLCRFFRMPRRVFNAQKKAQSSTD*SGGSSGGSSGSETPGTSES*

*ATPESSGGSSGGS*DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

A1LLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKRYTSTKEVLDATLIHQSI

TGLYETRIDLSQLGGD<u>EGADKRTADGSEFESPKKKRKV</u>* (SEQ ID NO: 166)

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.8-d, which comprises or consists essentially of the following sequence or a fragment thereof having adenosine deaminase activity:

ABE8.8-d
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTD*SGGSSGGSSGSETPGTSES*

*ATPESSGGSSGGSS*EVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLH<u>H</u>PGMNHRVEITEGILADECAALLC<u>R</u>FFRMPR<u>R</u>VFNAQKKAQSSTD*SGGSSGG*

*SSGSETPGTSESATPESSGGSSGGS*DKKYSIGL<u>A</u>IGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECFDSVEISGVEDRFNASLGTYHD

LLKIIKDKDFLDNEENEDILEDIVLTLTLFEDREMIEERLKTYAHLFDDKVMKQLKRRRYTG

WGRLSRKLINGIRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQ

SFLKDDSIDNKVLTRSDKNRGKSDNVPSEEVVKKMKNYWRQLLNAKLITQRKFDNLTKAERG

GLSELDKAGFIKRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYFDTTIDRKRYTSTK

EVLDATLIHQSITGLYETRIDLSQLGGD<u>EGADKRTADGSEFESPKKKRKV</u>*
(SEQ ID NO: 167)

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-m, which comprises or consists essentially of the following sequence or a fragment thereof having adenosine deaminase activity:

```
ABE8.13-m
MSEVEFSHEYWMRHALTLAKRARDEREVPVGAVLVLNNRVIGEGWNRAIGLHDPTAHAEIMA

LRQGGLVMQNYRLYDATLYVTFEPCVMCAGAMIHSRIGRVVFGVRNAKTGAAGSLMDVLHHP

GMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

A1LLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKRYTSTKEVLDATLIHQSI

TGLYETRIDLSQLGGDEGADKRTADGSEFESPKKKRKV* (SEQ ID NO: 168)
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-d, which comprises or consists essentially of the following sequence or a fragment thereof having adenosine deaminase activity:

```
ABE8.13-d
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLYDATLYVTFEPCVMCAGAMIHSRIGRVVFGVRNAKTG

AAGSLMDVLHHPGMNHRVEITEGILADECAALLCRFFRMPRRVFNAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECFDSVEISGVEDRFNASLGTYHD

LLKIIKDKDFLDNEENEDILEDIVLTLTLFEDREMIEERLKTYAHLFDDKVMKQLKRRRYTG

WGRLSRKLINGIRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQ

SFLKDDSIDNKVLTRSDKNRGKSDNVPSEEVVKKMKNYWRQLLNAKLITQRKFDNLTKAERG

GLSELDKAGFIKRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYFDTTIDRKRYTSTK

EVLDATLIHQSITGLYETRIDLSQLGGDEGADKRTADGSEFESPKKKRKV*
(SEQ ID NO: 169)
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-m, which comprises or consists essentially of the following sequence or a fragment thereof having adenosine deaminase activity:

ABE8.17-m
MSEVEFSHEYWMRHALTLAKRARDEREVPVGAVLVLNNRVIGEGWNRAIGLHDPTAHAEIMA

LRQGGLVMQNYRLIDATLY<u>S</u>TFEPCVMCAGAMIHSRIGRVVFGVRNAKTGAAGSLMDVLHYP

GMNHRVEITEGILADECAALLCYFFRMPR<u>R</u>VFNAQKKAQSSTD*SGGSSGGSSGSETPGTSES*

*ATPESSGGSSGGS*DKKYSIGL<u>A</u>IGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKRYTSTKEVLDATLIHQSI

TGLYETRIDLSQLGGD<u>EGADKRTADGSEFESPKKKRKV</u>* (SEQ ID NO: 170)

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-d, which comprises or consists essentially of the following sequence or a fragment thereof having adenosine deaminase activity:

```
ABE8.17-d
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYSTFEPCVMCAGAMIHSRIGRVVFGVRNAKTG

AAGSLMDVLHYPGMNHRVEITEGILADECAALLCYFFRMPRRVFNAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECFDSVEISGVEDRFNASLGTYHD

LLKIIKDKDFLDNEENEDILEDIVLTLTLFEDREMIEERLKTYAHLFDDKVMKQLKRRRYTG

WGRLSRKLINGIRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQ

SFLKDDSIDNKVLTRSDKNRGKSDNVPSEEVVKKMKNYWRQLLNAKLITQRKFDNLTKAERG

GLSELDKAGFIKRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYFDTTIDRKRYTSTK

EVLDATLIHQSITGLYETRIDLSQLGGDEGADKRTADGSEFESPKKKRKV*
(SEQ ID NO: 171)
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-m, which comprises or consists essentially of the following sequence or a fragment thereof having adenosine deaminase activity:

ABE8.20-m
MSEVEFSHEYWMRHALTLAKRARDEREVPVGAVLVLNNRVIGEGWNRAIGLHDPTAHAEIMA

LRQGGLVMQNYRLYDATLYSTFEPCVMCAGAMIHSRIGRVVFGVRNAKTGAAGSLMDVLHHP

GMNHRVEITEGILADECAALLCRFFRMPRRVFNAQKKAQSSTD*SGGSSGGSSGSETPGTSES*

*ATPESSGGSSGGS*DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

A1LLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKRYTSTKEVLDATLIHQSI

TGLYETRIDLSQLGGDEGADKRTADGSEFESPKKKRKV* (SEQ ID NO: 172)

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-d, which comprises or consists essentially of the following sequence or a fragment thereof having adenosine deaminase activity:

```
ABE8.20-d
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLYDATLYSTFEPCVMCAGAMIHSRIGRVVFGVRNAKTG

AAGSLMDVLHHPGMNHRVEITEGILADECAALLCRFFRMPRRVFNAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECFDSVEISGVEDRFNASLGTYHD

LLKIIKDKDFLDNEENEDILEDIVLTLTLFEDREMIEERLKTYAHLFDDKVMKQLKRRRYTG

WGRLSRKLINGIRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQ

SFLKDDSIDNKVLTRSDKNRGKSDNVPSEEVVKKMKNYWRQLLNAKLITQRKFDNLTKAERG

GLSELDKAGFIKRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYFDTTIDRKRYTSTK

EVLDATLIHQSITGLYETRIDLSQLGGDEGADKRTADGSEFESPKKKRKV*
(SEQ ID NO: 173)
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, an ABE8 of the disclosure is selected from the following sequences:

```
01. monoABE8.1_bpNLS + Y147T
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIV+32TLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 174)

02. monoABE8.1_bpNLS + Y147R
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCRFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD
```

-continued

```
AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 175)

03. monoABE8.1_bpNLS + Q154S
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCYFFRMPRSVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI
```

-continued

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 176)

4. monoABE8.1_bpNLS + Y123H
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHHP

GMNHRVEITEGILADECAALLCYFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 177)

5. monoABE8.1_bpNLS + V82S
MSEVEFSHEYWMRHALTLAKRARDEREVPVGAVLVLNNRVIGEGWNRAIGLHDPTAHAEIMA

LRQGGLVMQNYRLIDATLYSTFEPCVMCAGAMIHSRIGRVVFGVRNAKTGAAGSLMDVLHYP

GMNHRVEITEGILADECAALLCYFFRMPRQVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

```
LRRQEDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAFLSGEQKK
AIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIKELGSQ
ILKEHPVENTQLQNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKVREINN
YHHAHDAYLNAVVGTALIKKYPKLESEFVYGDYKVYDVRKMIAKSEQEIGKATAKYFFYSNI
MNFFKTEITLANGEIRKRPLIETNGETGEIVWDKGRDFATVRKVLSMPQVNIVKKTEVQTGG
FSKESILPKRNSDKLIARKKDWDPKKYGGFVSPTVAYSVLVVAKVEKGKSKKLKSVKELLGI
TIMERSSFEKNPIDFLEAKGYKEVKKDLIIKLPKYSLFELENGRKRMLASARELQKGNELAL
PSKYVNFLYLASHYEKLKGSPEDNEQKQLFVEQHKHYLDEIIEQISEFSKRVILADANLDKV
LSAYNKHRDKPIREQAENIIHLFTLTNLGAPAAFKYFDTTIDRKQYRSTKEVLDATLIHQSI
TGLYETRIDLSQLGGDEGADKRTADGSEFESPKKKRKV (SEQ ID NO: 178)

06. monoABE8.1_bpNLS + T166R
MSEVEFSHEYWMRHALTLAKRARDEREVPVGAVLVLNNRVIGEGWNRAIGLHDPTAHAEIMA
LRQGGLVMQNYRLIDATLYVTFEPCVMCAGAMIHSRIGRVVFGVRNAKTGAAGSLMDVLHYP
GMNHRVEITEGILADECAALLCYFFRMPRQVFNAQKKAQSSRDSGGSSGGSSGSETPGTSES
ATPESSGGSSGGSDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMIKFRGHFLIEGDL
NPDNSDVDKLFIQLVQTYNQLFEENPINASGVDAKAILSARLSKSRRLENLIAQLPGEKKNG
LFGNLIALSLGLTPNFKSNFDLAEDAKLQLSKDTYDDDLDNLLAQIGDQYADLFLAAKNLSD
AILLSDILRVNTEITKAPLSASMIKRYDEHHQDLTLLKALVRQQLPEKYKEIFFDQSKNGYA
GYIDGGASQEEFYKFIKPILEKMDGTEELLVKLNREDLLRKQRTFDNGSIPHQIHLGELHAI
LRRQEDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAFLSGEQKK
AIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIKELGSQ
ILKEHPVENTQLQNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKVREINN
YHHAHDAYLNAVVGTALIKKYPKLESEFVYGDYKVYDVRKMIAKSEQEIGKATAKYFFYSNI
MNFFKTEITLANGEIRKRPLIETNGETGEIVWDKGRDFATVRKVLSMPQVNIVKKTEVQTGG
FSKESILPKRNSDKLIARKKDWDPKKYGGFVSPTVAYSVLVVAKVEKGKSKKLKSVKELLGI
TIMERSSFEKNPIDFLEAKGYKEVKKDLIIKLPKYSLFELENGRKRMLASARELQKGNELAL
PSKYVNFLYLASHYEKLKGSPEDNEQKQLFVEQHKHYLDEIIEQISEFSKRVILADANLDKV
```

-continued

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 179)

07. monoABE8.1_bpNLS + Q154R
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCYFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 180)

08. monoABE8.1_bpNLS + Y147R_Q154R_Y123H
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHHP

GMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

-continued

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 181)

9. monoABE8.1_bpNLS + Y147R_Q154R_I76Y
MSEVEFSHEYWMRHALTLAKRARDEREVPVGAVLVLNNRVIGEGWNRAIGLHDPTAHAEIMA

LRQGGLVMQNYRLYDATLYVTFEPCVMCAGAMIHSRIGRVVFGVRNAKTGAAGSLMDVLHYP

GMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

-continued

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 182)

10. monoABE8.1_bpNLS + Y147R_Q154R_T166R
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCRFFRMPRRVFNAQKKAQSSRDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 183)

11. monoABE8.1_bpNLS + Y147T_Q154R
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

-continued

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 184)

12. monoABE8.1_bpNLS + Y147T_Q154S
MSEVEFSHEYWMRHALTLAKRARDEREVPVGAVLVLNNRVIGEGWNRAIGLHDPTAHAEIMA

LRQGGLVMQNYRLIDATLYVTFEPCVMCAGAMIHSRIGRVVFGVRNAKTGAAGSLMDVLHYP

GMNHRVEITEGILADECAALLCTFFRMPRSVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 185)

13. monoABE8.1_bpNLS + H123Y123H_Y147R_Q154R_I76Y
MSEVEFSHEYWMRHALTLAKRARDEREVPVGAVLVLNNRVIGEGWNRAIGLHDPTAHAEIMA

LRQGGLVMQNYRLYDATLYVTFEPCVMCAGAMIHSRIGRVVFGVRNAKTGAAGSLMDVLHHP

GMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 186)

14. monoABE8.1_bpNLS + V82S + Q154R
MSEVEFSHEYWMRHALTLAKRARDEREVPVGAVLVLNNRVIGEGWNRAIGLHDPTAHAEIMA

LRQGGLVMQNYRLIDATLYSTFEPCVMCAGAMIHSRIGRVVFGVRNAKTGAAGSLMDVLHYP

GMNHRVEITEGILADECAALLCYFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNG

LFGNLIALSLGLTPNFKSNFDLAEDAKLQLSKDTYDDDLDNLLAQIGDQYADLFLAAKNLSD

AILLSDILRVNTEITKAPLSASMIKRYDEHHQDLTLLKALVRQQLPEKYKEIFFDQSKNGYA

GYIDGGASQEEFYKFIKPILEKMDGTEELLVKLNREDLLRKQRTFDNGSIPHQIHLGELHAI

LRRQEDFYPFLKDNREKIEKILTFRIPYYVGPLARGNSRFAWMTRKSEETITPWNFEEVVDK

```
-continued
GASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGG

FSKESILPKRNSDKLIARKKDWDPKKYGGFVSPTVAYSVLVVAKVEKGKSKKLKSVKELLGI

TIMERSSFEKNPIDFLEAKGYKEVKKDLIIKLPKYSLFELENGRKRMLASARELQKGNELAL

PSKYVNFLYLASHYEKLKGSPEDNEQKQLFVEQHKHYLDEIIEQISEFSKRVILADANLDKV

LSAYNKHRDKPIREQAENIIHLFTLTNLGAPAAFKYFDTTIDRKQYRSTKEVLDATLIHQSI

TGLYETRIDLSQLGGDEGADKRTADGSEFESPKKKRKV (SEQ ID NO: 187)
```

In some embodiments, the base editor is a fusion protein comprising a polynucleotide programmable nucleotide binding domain (e.g., Cas9-derived domain) fused to a nucleobase editing domain (e.g., all or a portion of a deaminase domain). In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the base editor further comprises a domain comprising all or a portion of a uracil glycosylase inhibitor (UGI). In some embodiments, the base editor comprises a domain comprising all or a portion of a uracil binding protein (UBP), such as a uracil DNA glycosylase (UDG). In some embodiments, the base editor comprises a domain comprising all or a portion of a nucleic acid polymerase. In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise an REC lobe and an NUC lobe corresponding to the REC lobe and NUC lobe of a wild-type or natural Cas9. In another example, the base editor can comprise one or more of a RuvCI domain, BH domain, REC1 domain, REC2 domain, RuvCII domain, L1 domain, HNH domain, L2 domain, RuvCIII domain, WED domain, TOPO domain or CTD domain. In some embodiments, one or more domains of the base editor comprise a mutation (e.g., substitution, insertion, deletion) relative to a wild-type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g., adjacent domains) of the base editor disclosed herein can be connected to each other with or without the use of one or more linker domains (e.g., an XTEN linker domain). In some embodiments, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., an adenosine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, poly amide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g., UGI, etc.).

Typically, a linker is positioned between, or flanked by, two groups, molecules, or other moieties and connected to each one via a covalent bond, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated. In some embodiments, a linker domain comprises the amino acid sequence SGSETPGTSESATPES (SEQ ID NO: 64), which can also be referred to as the XTEN linker. Any method for linking the fusion protein domains can be employed (e.g., ranging from very flexible linkers of the form (SGGS)n (SEQ ID NO: 188), (GGGS)n (SEQ ID NO: 189), (GGGGS)n (SEQ ID NO: 190), and (G)n, to more rigid linkers of the form (EAAAK)n (SEQ ID NO: 191), (GGS)n, SGSETPGTSESATPES (SEQ ID NO: 64) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference), or $(XP)_n$ motif, in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 192). In some embodiments, the Cas9 domain of the fusion proteins provided herein are fused via a linker comprising the amino acid sequence SGSETPGTSESATPES (SEQ ID NO: 64). In some embodiments, a linker comprises a plurality of proline residues and is 5-21, 5-14, 5-9, 5-7 amino acids in length, e.g., PAPAP (SEQ ID NO: 193), PAPAPA (SEQ ID NO: 194), PAPAPAP (SEQ ID NO: 195), PAPAPAPA (SEQ ID NO: 196), P(AP)$_4$ (SEQ ID NO: 197), P(AP)$_7$ (SEQ ID NO: 198), P(AP)$_{10}$ (SEQ ID NO: 199) (see, e.g., Tan J, Zhang F, Karcher D, Bock R. Engineering of high-precision base editors for site-specific single nucleotide replacement. Nat Commun. 2019 Jan. 25; 10(1):439; the entire contents are incorporated herein by reference). Such proline-rich linkers are also termed "rigid" linkers.

A fusion protein of the disclosure comprises a nucleic acid editing domain. In some embodiments, the deaminase is an adenosine deaminase. In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase.

Linkers

In certain embodiments, linkers may be used to link any of the peptides or peptide domains of the disclosure. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length.

In some embodiments, the adenosine deaminase and the napDNAbp are fused via a linker that is 4, 16, 32, or 104 amino acids in length. In some embodiments, the linker is about 3 to about 104 amino acids in length. In some embodiments, any of the fusion proteins provided herein, comprise an adenosine deaminase and a Cas9 domain that are fused to each other via a linker. Various linker lengths and flexibilities between the deaminase domain (e.g., an engineered ecTadA) and the Cas9 domain can be employed (e.g., ranging from very flexible linkers of the form $(GGGS)_n$ (SEQ ID NO: 189), $(GGGGS)_n$ (SEQ ID NO: 190), and $(G)_n$ to more rigid linkers of the form $(EAAAK)_n$ (SEQ ID NO: 191), $(SGGS)_n$ (SEQ ID NO: 188), SGSETPGTSESATPES (SEQ ID NO: 64) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and $(XP)_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 192). In some embodiments, the adenosine deaminase and the Cas9 domain of any of the fusion proteins provided herein are fused via a linker (e.g., an XTEN linker) comprising the amino acid sequence SGSETPGTSESATPES (SEQ ID NO: 64).

Cas9 Complexes with Guide RNAs

Some aspects of this disclosure provide complexes comprising any of the fusion proteins provided herein, and a guide RNA (e.g., a guide that targets A mutation) bound to a CAS9 domain (e.g., a dCas9, a nuclease active Cas9, or a Cas9 nickase) of fusion protein. Any method for linking the fusion protein domains can be employed (e.g., ranging from very flexible linkers of the form (GGGS)$_n$ (SEQ ID NO: 189), (GGGGS)$_n$ (SEQ ID NO: 190), and (G)$_n$ to more rigid linkers of the form (EAAAK)$_n$ (SEQ ID NO: 191), (SGGS)$_n$ (SEQ ID NO: 188), SGSETPGTSESATPES (SEQ ID NO: 64) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and (XP)$_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a (GGS)$_n$ motif, wherein n is 1, 3, or 7 (SEQ ID NO: 192). In some embodiments, the Cas9 domain of the fusion proteins provided herein are fused via a linker comprising the amino acid sequence SGSETPGTSESATPES (SEQ ID NO: 64).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 2 or 5'-NAA-3'). In some embodiments, the guide nucleic acid (e.g., guide RNA) is complementary to a sequence in a gene of interest (e.g., a gene associated with a disease or disorder).

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Cas12 Complexes with Guide RNAs

Some aspects of this disclosure provide complexes comprising any of the fusion proteins provided herein, and a guide RNA (e.g., a guide that targets a target polynucleotide for editing).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence. In some embodiments, the 3' end of the target sequence is immediately adjacent to a non-canonical PAM sequence.

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an e.g., TTN, DTTN, GTTN, ATTN, ATTC, DTTNT, WTTN, HATY, TTTN, TTTV, TTTC, TG, RTR, or YTN PAM site.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas12 binding, and a guide sequence, which confers sequence specificity to the Cas12:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas12:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

The domains of the base editor disclosed herein can be arranged in any order as long as the deaminase domain is internalized in the Cas12 protein. Non-limiting examples of a base editor comprising a fusion protein comprising e.g., a Cas12 domain and a deaminase domain can be arranged as following:
NH2-[Cas12 domain]-Linker1-[ABE8]-Linker2-[Cas12 domain]-COOH;
NH2-[Cas12 domain]-Linker1-[ABE8]-[Cas12 domain]-COOH;
NH2-[Cas12 domain]-[ABE8]-Linker2-[Cas12 domain]-COOH;
NH2-[Cas12 domain]-[ABE8]-[Cas12 domain]-COOH;
NH2-[Cas12 domain]-Linker1-[ABE8]-Linker2-[Cas12 domain]-[inosine BER inhibitor]-COOH;
NH2-[Cas12 domain]-Linker1-[ABE8]-[Cas12 domain]-[inosine BER inhibitor]-COOH;
NH2-[Cas12 domain]-[ABE8]-Linker2-[Cas12 domain]-[inosine BER inhibitor]-COOH;
NH2-[Cas12 domain]-[ABE8]-[Cas12 domain]-[inosine BER inhibitor]-COOH;
NH2-[inosine BER inhibitor]-[Cas12 domain]-Linker1-[ABE8]-Linker2-[Cas12 domain]-COOH;
NH2-[inosine BER inhibitor]-[Cas12 domain]-Linker1-[ABE8]-[Cas12 domain]-COOH;
NH2-[inosine BER inhibitor]-[Cas12 domain]-[ABE8]-Linker2-[Cas12 domain]-COOH;
NH2-[inosine BER inhibitor]NH2-[Cas12 domain]-[ABE8]-[Cas12 domain]-COOH;

Additionally, in some cases, a Gam protein can be fused to an N terminus of a base editor. In some cases, a Gam protein can be fused to a C terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some cases, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitution(s) in any domain does/do not change the length of the base editor. Non-limiting examples of such base editors, where the length of all the domains is the same as the wild type domains, can include:
NH2-[Cas12 domain]-Linker1-[APOBEC1]-Linker2-[Cas12 domain]-COOH;
NH2-[Cas12 domain]-Linker1-[APOBEC1]-[Cas12 domain]-COOH;
NH2-[Cas12 domain]-[APOBEC1]-Linker2-[Cas12 domain]-COOH;
NH2-[Cas12 domain]-[APOBEC1]-[Cas12 domain]-COOH;
NH2-[Cas12 domain]-Linker1-[APOBEC1]-Linker2-[Cas12 domain]-[UGI]-COOH;
NH2-[Cas12 domain]-Linker1-[APOBEC1]-[Cas12 domain]-[UGI]-COOH;
NH2-[Cas12 domain]-[APOBEC1]-Linker2-[Cas12 domain]-[UGI]-COOH;
NH2-[Cas12 domain]-[APOBEC1]-[Cas12 domain]-[UGI]-COOH;
NH2-[UGI]-[Cas12 domain]-Linker1-[APOBEC1]-Linker2-[Cas12 domain]-COOH;
NH2-[UGI]-[Cas12 domain]-Linker1-[APOBEC1]-[Cas12 domain]-COOH;
NH2-[UGI]-[Cas12 domain]-[APOBEC1]-Linker2-[Cas12 domain]-COOH;
NH2-[UGI]-[Cas12 domain]-[APOBEC1]-[Cas12 domain]-COOH;

In some embodiments, the base editing fusion proteins provided herein need to be positioned at a precise location, for example, where a target base is placed within a defined region (e.g., a "deamination window"). In some cases, a target can be within a 4-base region. In some cases, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A defined target region can be a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a napDNAbp domain. In some embodiments, an NLS of the base editor is localized C-terminal to a napDNAbp domain.

Protein domains included in the fusion protein can be a heterologous functional domain. Non-limiting examples of protein domains which can be included in the fusion protein include a deaminase domain (e.g., cytidine deaminase and/or adenosine deaminase; see PCT/US2019/044935, PCT/US2020/016288, each of which is incorporated herein by reference for its entirety), a uracil glycosylase inhibitor (UGI) domain, epitope tags, and reporter gene sequences. Protein domains can be a heterologous functional domain, for example, having one or more of the following activities: transcriptional activation activity, transcriptional repression activity, transcription release factor activity, gene silencing activity, chromatin modifying activity, epigenetic modifying activity, histone modification activity, RNA cleavage activity, and nucleic acid binding activity. Such heterologous functional domains can confer a function activity, such as modification of a target polypeptide associated with target DNA (e.g., a histone, a DNA binding protein, etc.), leading to, for example, histone methylation, histone acetylation, histone ubiquitination, and the like. Other functions and/or activities conferred can include transposase activity, integrase activity, recombinase activity, ligase activity, ubiquitin ligase activity, deubiquitinating activity, adenylation activity, deadenylation activity, SUMOylation activity, deSUMOylation activity, or any combination of the above.

A domain may be detected or labeled with an epitope tag, a reporter protein, other binding domains. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions.

In some embodiments, BhCas12b guide polynucleotide has the following sequence:

BhCas12b sgRNA scaffold (underlined) + 20 nt to
23 nt guide sequence (denoted by N$_n$)
5' <u>GUUCUGTCUUUUGGUCAGGACAACCGUCUAGCUAUAAGUGCUGCAG</u>
<u>GGUGUGAGAAACUCCUAUUGCUGGACGAUGUCUCUUACGAGGCAUUAGC</u>
<u>AC</u>NNNNNNNNNNNNNNNNNNNNNN-3' (SEQ ID NO: 200)

In some embodiments, BvCas12b and AaCas12b guide polynucleotides have the following sequences:

BvCas12b sgRNA scaffold (underlined) + 20 nt to
23 nt guide sequence (denoted by N$_n$)
5' <u>GACCUAUAGGGUCAAUGAAUCUGUGCGUGUGCCAUAAGUAAUUAAAA</u>
<u>AUUACCCACCACAGGAGCACCUGAAAACAGGUGCUUGGCAC</u>NNNNNNNNNN
NNNNNNNNNNNN-3' (SEQ ID NO: 201)

AaCas12b sgRNA scaffold (underlined) + 20 nt to
23 nt guide sequence (denoted by N$_n$)
5' <u>GUCUAAAGGACAGAAUUUUUCAACGGGUGUGCCAAUGGCCACUUUCC</u>
<u>AGGUGGCAAAGCCCGUUGAACUUCUCAAAAAGAACGAUCUGAGAAGUGGC</u>
<u>AC</u>NNNNNNNNNNNNNNNNNNNNNNN-3' (SEQ ID NO: 202)

Methods of Using Fusion Proteins Comprising Adenosine Deaminase Variant and a Cas9 Domain Some aspects of this disclosure provide methods of using the fusion proteins, or complexes provided herein. For example, some aspects of this disclosure provide methods comprising contacting a DNA molecule encoding a mutant form of a protein with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and an adenosine deaminase variant (e.g., ABE8), as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

CRISPR-Cas9 nucleases have been widely used to mediate targeted genome editing. In most genome editing applications, Cas9 forms a complex with a guide polynucleotide (e.g., single guide RNA (sgRNA)) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR). Unfortunately, under most non-perturbative conditions, HDR is inefficient, dependent on cell state and cell type, and dominated by a larger frequency of indels. As most of the known genetic variations associated with human disease are point mutations, methods that can more efficiently and cleanly make precise point mutations are needed. Base editing systems as provided herein provide a new way to provide genome editing without generating double-strand DNA breaks, without requiring a donor DNA template, and without inducing an excess of stochastic insertions and deletions.

The fusion proteins of the disclosure advantageously modify a specific nucleotide base encoding a protein comprising a mutation without generating a significant proportion of indels. An "indel," as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., mutations) versus indels.

In some embodiments, any of base editor systems provided herein result in less than 50%, less than 40%, less than 30%, less than 20%, less than 19%, less than 18%, less than 17%, less than 16%, less than 15%, less than 14%, less than 13%, less than 12%, less than 110, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence.

In some embodiments, any of base editor systems comprising one of the ABE8 base editor variants described herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence. In some embodiments, any of base editor systems comprising one of the ABE8 base editor variants described herein result in less than 0.8% indel formation in the target polynucleotide sequence. In some embodiments, any of base editor systems comprising one of the ABE8 base editor variants described herein result in at most 0.8% indel formation in the target polynucleotide sequence. In some embodiments, any of base editor systems comprising one of the ABE8 base editor variants described herein result in less than 0.3% indel formation in the target polynucleotide sequence. In some embodiments, any of base editor systems comprising one of the ABE8 base editor variants described results in lower indel formation in the target polynucleotide sequence compared to a base editor system comprising one of ABE7 base editors. In some embodiments, any of base editor systems comprising one of the ABE8 base editor variants described herein results in lower indel formation in the target polynucleotide sequence compared to a base editor system comprising an ABE7.10.

In some embodiments, any of base editor systems comprising one of the ABE8 base editor variants described herein has reduction in indel frequency compared to a base editor system comprising one of the ABE7 base editors. In some embodiments, any of base editor systems comprising one of the ABE8 base editor variants described herein has at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% reduction in indel frequency compared to a base editor system comprising one of the ABE7 base editors. In some embodiments, a base editor system comprising one of the ABE8 base editor variants described herein has at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% reduction in indel frequency compared to a base editor system comprising an ABE7.10.

The disclosure provides adenosine deaminase variants (e.g., ABE8 variants) that have increased efficiency and specificity. In particular, the adenosine deaminase variants described herein are more likely to edit a desired base within a polynucleotide, and are less likely to edit bases that are not intended to be altered (e.g., "bystanders").

In some embodiments, any of the base editing system comprising one of the ABE8 base editor variants described herein has reduced bystander editing or mutations. In some embodiments, an unintended editing or mutation is a bystander mutation or bystander editing, for example, base editing of a target base (e.g., A or C) in an unintended or non-target position in a target window of a target nucleotide sequence. In some embodiments, any of the base editing system comprising one of the ABE8 base editor variants described herein has reduced bystander editing or mutations compared to a base editor system comprising an ABE7 base editor, e.g., ABE7.10. In some embodiments, any of the base editing system comprising one of the ABE8 base editor variants described herein has reduced bystander editing or mutations by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% compared to a base editor system comprising an ABE7 base editor, e.g., ABE7.10. In some embodiments, any of the base editing system comprising one of the ABE8 base editor variants described herein has reduced bystander editing or mutations by at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold compared to a base editor system comprising an ABE7 base editor, e.g., ABE7.10.

In some embodiments, any of the base editing system comprising one of the ABE8 base editor variants described herein has reduced spurious editing. In some embodiments, an unintended editing or mutation is a spurious mutation or spurious editing, for example, non-specific editing or guide independent editing of a target base (e.g., A or C) in an unintended or non-target region of the genome. In some embodiments, any of the base editing system comprising one of the ABE8 base editor variants described herein has reduced spurious editing compared to a base editor system comprising an ABE7 base editor, e.g., ABE7.10. In some embodiments, any of the base editing system comprising one of the ABE8 base editor variants described herein has reduced spurious editing by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% compared to a base editor system comprising an ABE7 base editor, e.g., ABE7.10. In some embodiments, any of the base editing system comprising one of the ABE8 base editor variants described herein has reduced spurious editing by at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold compared to a base editor system comprising an ABE7 base editor, e.g., ABE7.10.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations, such as unintended point mutations (i.e., mutation of bystanders). In some embodiments, any of the base editors provided herein are capable of generating at least 0.01% of intended mutations (i.e., at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% base editing efficiency. In some embodiments, the base editing efficiency may be measured by calculating the percentage of edited nucleobases in a population of cells. In some embodiments, any of the ABE8 base editor variants described herein have base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases in a population of cells.

In some embodiments, any of the ABE8 base editor variants described herein has higher base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher base editing efficiency compared to an ABE7 base editor, e.g., ABE7.10.

In some embodiments, any of the ABE8 base editor variants described herein have at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% on-target base editing efficiency. In some embodiments, any of the ABE8 base editor variants described herein have on-target base editing efficiency of at least 0.01%, at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited target nucleobases in a population of cells.

In some embodiments, any of the ABE8 base editor variants described herein has higher on-target base editing efficiency compared to the ABE7 base editors. In some embodiments, any of the ABE8 base editor variants described herein have at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300%, at least 310%, at least 320%, at least 330%, at least 340%, at least 350%, at least 360%, at least 370%, at least 380%, at least 390%, at least 400%, at least 450%, or at least 500% higher on-target base editing efficiency compared to an ABE7 base editor, e.g., ABE7.10.

In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target base editing efficiency compared to an ABE7 base editor, e.g., ABE7.10.

The ABE8 base editor variants described herein may be delivered to a host cell via a plasmid, a vector, a LNP complex, or an mRNA. In some embodiments, any of the ABE8 base editor variants described herein is delivered to a host cell as an mRNA. In some embodiments, an ABE8 base editor delivered via a nucleic acid based delivery system, e.g., an mRNA, has on-target editing efficiency of at least at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% as measured by edited nucleobases. In some embodiments, an ABE8 base editor delivered by an mRNA system has higher base editing efficiency compared to an ABE8 base editor delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% on-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 3.6 fold, at least 3.7 fold, at least 3.8 fold, at least 3.9 fold, at least 4.0 fold, at least 4.1 fold, at least 4.2 fold, at least 4.3 fold, at least 4.4 fold, at least 4.5 fold, at least 4.6 fold, at least 4.7 fold, at least 4.8 fold, at least 4.9 fold, or at least 5.0 fold higher on-target editing efficiency when delivered by an mRNA system compared to when delivered by a plasmid or vector system.

In some embodiments, any of base editor systems comprising one of the ABE8 base editor variants described herein result in less than 50%, less than 40%, less than 30%, less than 20%, less than 19%, less than 18%, less than 17%, less than 16%, less than 15%, less than 14%, less than 13%, less than 12%, less than 110, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% off-target editing in the target polynucleotide sequence.

In some embodiments, any of the ABE8 base editor variants described herein has lower guided off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guided off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, or at least 3.0 fold lower guided off-target editing efficiency when delivered by an mRNA system compared to when delivered by a plasmid or vector system. In some embodiments, any of the ABE8 base editor variants described herein has at least about 2.2 fold decrease in guided off-target editing efficiency when delivered by an mRNA system compared to when delivered by a plasmid or vector system.

In some embodiments, any of the ABE8 base editor variants described herein has lower guide-independent off-target editing efficiency when delivered by an mRNA system compared to when delivered by a plasmid or vector system. In some embodiments, any of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% lower guide-independent off-target editing efficiency when delivered by an mRNA system compared to when delivered by a plasmid or vector system. In some embodiments, any of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 5.0 fold, at least 10.0 fold, at least 20.0 fold, at least 50.0 fold, at least 70.0 fold, at least 100.0 fold, at least 120.0 fold, at least 130.0 fold, or at least 150.0 fold lower guide-independent off-target editing efficiency when delivered by an mRNA system compared to when delivered by a plasmid or vector system. In some embodiments, ABE8 base editor variants described herein has 134.0 fold decrease in guide-independent off-target editing efficiency (e.g., spurious RNA deamination) when delivered by an mRNA system compared to when delivered by a plasmid or vector system. In some embodiments, ABE8 base editor variants described herein does not increase guide-independent mutation rates across the genome.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations (e.g., spurious off-target editing or bystander editing). In some embodiments, an intended mutation is a mutation that is generated by a specific base editor bound to a gRNA, specifically designed to alter or correct a mutation in a target gene. Some aspects of the disclosure are based on the recognition that any of the base editors provided herein are capable of efficiently generating an intended mutation in a nucleic acid (e.g. a nucleic acid within a genome of a subject) without generating a significant number of unintended mutations. In some embodiments, an intended mutation is a mutation that is generated by a specific base editor bound to a gRNA, specifically designed to alter or correct an intended mutation. In some embodiments, the intended mutation is a mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor).

In some embodiments, the base editors provided herein are capable of generating a ratio of intended mutations to indels (i.e., unintended mutations) that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. It should be appreciated that the characteristics of the base editors described herein may be applied to any of the fusion proteins, or methods of using the fusion proteins provided herein.

The number of intended mutations and indels can be determined using any suitable method, for example, as described in International PCT Application Nos. PCT/2017/045381 (WO2018/027078) and PCT/US2016/058344 (WO2017/070632); Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, any number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor system. In some embodiments, the multiplex editing can comprise one or more base editor systems with a single guide polynucleotide. In some embodiments, the multiplex editing can comprise one or more base editor system with a plurality of guide polynucleotides. In some embodiments, the multiplex editing can comprise one or more guide polynucleotide with a single base editor system. In some embodiments, the multiplex editing can comprise at least one guide polynucleotide that does not require a PAM sequence to target binding to a target polynucleotide sequence. In some embodiments, the multiplex editing can comprise at least one guide polynucleotide that requires a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editor provided herein. It should also be appreciated that the multiplex editing using any of the base editors as described herein can comprise a sequential editing of a plurality of nucleobase pairs.

In some embodiments, the plurality of nucleobase pairs are in one more genes. In some embodiments, the plurality of nucleobase pairs is in the same gene. In some embodiments, at least one gene in the one more genes is located in a different locus.

In some embodiments, the editing is editing of the plurality of nucleobase pairs in at least one protein coding region. In some embodiments, the editing is editing of the plurality of nucleobase pairs in at least one protein non-coding region. In some embodiments, the editing is editing of the plurality of nucleobase pairs in at least one protein coding region and at least one protein non-coding region.

In some embodiments, the editing is in conjunction with one or more guide polynucleotides. In some embodiments, the base editor system can comprise one or more base editor system. In some embodiments, the base editor system can comprise one or more base editor systems in conjunction with a single guide polynucleotide. In some embodiments, the base editor system can comprise one or more base editor system in conjunction with a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence. In some embodiments, the editing is in conjunction with at least one guide polynucleotide that require a PAM sequence to target binding to a target polynucleotide sequence. In some embodiments, the editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

In some embodiments, the base editor system capable of multiplex editing of a plurality of nucleobase pairs in one or more genes comprises one of the ABE8 base editor variants described herein. In some embodiments, the base editor system capable of multiplex editing of a plurality of nucleobase pairs in one or more genes comprises one of ABE7 base editors. In some embodiments, the base editor system capable of multiplex editing comprising one of the ABE8 base editor variants described herein has higher multiplex editing efficiency compared the base editor system capable of multiplex editing comprising one of ABE7 base editors. In some embodiments, the base editor system capable of multiplex editing comprising one of the ABE8 base editor variants described herein has at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 99%, at least 100%, at least 105%, at least 110%, at least 115%, at least 120%, at least 125%, at least 130%, at least 135%, at least 140%, at least 145%, at least 150%, at least 155%, at least 160%, at least 165%, at least 170%, at least 175%, at least 180%, at least 185%, at least 190%, at least 195%, at least 200%, at least 210%, at least 220%, at least 230%, at least 240%, at least 250%, at least 260%, at least 270%, at least 280%, at least 290%, at least 300% higher, at least 310%, at least 320%, at least 330%, at least 340%, at least 350%, at least 360%, at least 370%, at least 380%, at least 390%, at least 400%, at least 450%, or at least 500% higher multiplex editing efficiency compared the base editor system capable of multiplex editing comprising one of ABE7 base editors. In some embodiments, the base editor system capable of multiplex editing comprising one of the ABE8 base editor variants described herein has at least 1.1 fold, at least 1.2 fold, at least 1.3 fold, at least 1.4 fold, at least 1.5 fold, at least 1.6 fold, at least 1.7 fold, at least 1.8 fold, at least 1.9 fold, at least 2.0 fold, at least 2.1 fold, at least 2.2 fold, at least 2.3 fold, at least 2.4 fold, at least 2.5 fold, at least 2.6 fold, at least 2.7 fold, at least 2.8 fold, at least 2.9 fold, at least 3.0 fold, at least 3.1 fold, at least 3.2 fold, at least 3.3 fold, at least 3.4 fold, at least 3.5 fold, at least 4.0 fold, at least 4.5 fold, at least 5.0 fold, at least 5.5 fold, or at least 6.0 fold higher multiplex editing efficiency compared the base editor system capable of multiplex editing comprising one of ABE7 base editors.

Fusion Proteins with Internal Insertions

Provided herein are fusion proteins comprising a heterologous polypeptide fused to a nucleic acid programmable nucleic acid binding protein, for example, a napDNAbp. A heterologous polypeptide can be a polypeptide that is not found in the native or wild-type napDNAbp polypeptide sequence. The heterologous polypeptide can be fused to the napDNAbp at a C-terminal end of the napDNAbp, an N-terminal end of the napDNAbp, or inserted at an internal location of the napDNAbp. In some embodiments, the heterologous polypeptide is inserted at an internal location of the napDNAbp.

In some embodiments, the heterologous polypeptide is a deaminase or a functional fragment thereof. For example, a fusion protein can comprise a deaminase flanked by an N-terminal fragment and a C-terminal fragment of a Cas9 or Cas12 (e.g., Cas12b/C2c1), polypeptide. The deaminase in a fusion protein can be an adenosine deaminase. In some embodiments, the adenosine deaminase is a TadA (e.g., TadA7.10 or TadA*8). In some embodiments, the TadA is a TadA*8. TadA sequences (e.g., TadA7.10 or TadA*8) as described herein are suitable deaminases for the above-described fusion proteins.

The deaminase can be a circular permutant deaminase. For example, the deaminase can be a circular permutant adenosine deaminase. In some embodiments, the deaminase is a circular permutant TadA, circularly permutated at amino acid residue 116 as numbered in the TadA reference sequence. In some embodiments, the deaminase is a circular permutant TadA, circularly permutated at amino acid residue 136 as numbered in the TadA reference sequence. In some embodiments, the deaminase is a circular permutant TadA, circularly permutated at amino acid residue 65 as numbered in the TadA reference sequence.

The fusion protein can comprise more than one deaminase. The fusion protein can comprise, for example, 1, 2, 3, 4, 5 or more deaminases. In some embodiments, the fusion protein comprises one deaminase. In some embodiments, the fusion protein comprises two deaminases. The two or more deaminases in a fusion protein can be an adenosine deaminase. cytidine deaminase, or a combination thereof. The two or more deaminases can be homodimers. The two or more deaminases can be heterodimers. The two or more deaminases can be inserted in tandem in the napDNAbp. In some embodiments, the two or more deaminases may not be in tandem in the napDNAbp.

In some embodiments, the napDNAbp in the fusion protein is a Cas9 polypeptide or a fragment thereof. The Cas9 polypeptide can be a variant Cas9 polypeptide. In some embodiments, the Cas9 polypeptide is a Cas9 nickase (nCas9) polypeptide or a fragment thereof. In some embodiments, the Cas9 polypeptide is a nuclease dead Cas9 (dCas9) polypeptide or a fragment thereof. The Cas9 polypeptide in a fusion protein can be a full-length Cas9 polypeptide. In some cases, the Cas9 polypeptide in a fusion protein may not be a full length Cas9 polypeptide. The Cas9 polypeptide can be truncated, for example, at a N-terminal or C-terminal end relative to a naturally-occurring Cas9 protein. The Cas9 polypeptide can be a circularly permuted Cas9 protein. The Cas9 polypeptide can be a fragment, a portion, or a domain of a Cas9 polypeptide, that is still capable of binding the target polynucleotide and a guide nucleic acid sequence.

In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or fragments or variants thereof.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas9 polypeptide.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to the Cas9 amino acid sequence set forth below (called the "Cas9 reference sequence" below):

MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

-continued

```
DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (SEQ ID NO: 1) (single underline: HNH domain; double
underline: RuvC domain).
```

Fusion proteins comprising a heterologous catalytic domain flanked by N- and C-terminal fragments of a Cas9 polypeptide are also useful for base editing in the methods as described herein. Fusion proteins comprising Cas9 and one or more deaminase domains, e.g., adenosine deaminase, or comprising an adenosine deaminase domain flanked by Cas9 sequences are also useful for highly specific and efficient base editing of target sequences. In an embodiment, a chimeric Cas9 fusion protein contains a heterologous catalytic domain (e.g., adenosine deaminase, cytidine deaminase, or adenosine deaminase and cytidine deaminase) inserted within a Cas9 polypeptide. In some embodiments, the fusion protein comprises an adenosine deaminase domain and a cytidine deaminase domain inserted within a Cas9. In some embodiments, an adenosine deaminase is fused within a Cas9 and a cytidine deaminase is fused to the C-terminus. In some embodiments, an adenosine deaminase is fused within Cas9 and a cytidine deaminase fused to the N-terminus. In some embodiments, a cytidine deaminase is fused within Cas9 and an adenosine deaminase is fused to the C-terminus. In some embodiments, a cytidine deaminase is fused within Cas9 and an adenosine deaminase fused to the N-terminus.

Exemplary structures of a fusion protein with an adenosine deaminase and a cytidine deaminase and a Cas9 are provided as follows:

NH$_2$-[Cas9(adenosine deaminase)]-[cytidine deaminase]-COOH;
NH$_2$-[cytidine deaminase]-[Cas9(adenosine deaminase)]-COOH;
NH$_2$-[Cas9(cytidine deaminase)]-[adenosine deaminase]-COOH; or
NH$_2$-[adenosine deaminase]-[Cas9(cytidine deaminase)]-COOH.

In some embodiments, the "-" used in the general architecture above indicates the presence of an optional linker.

In various embodiments, the catalytic domain has DNA modifying activity (e.g., deaminase activity), such as adenosine deaminase activity. In some embodiments, the adenosine deaminase is a TadA (e.g., TadA7.10). In some embodiments, the TadA is a TadA*8. In some embodiments, a TadA*8 is fused within Cas9 and a cytidine deaminase is fused to the C-terminus. In some embodiments, a TadA*8 is fused within Cas9 and a cytidine deaminase fused to the N-terminus. In some embodiments, a cytidine deaminase is fused within Cas9 and a TadA*8 is fused to the C-terminus. In some embodiments, a cytidine deaminase is fused within Cas9 and a TadA*8 fused to the N-terminus. Exemplary structures of a fusion protein with a TadA*8 and a cytidine deaminase and a Cas9 are provided as follows:

NH$_2$-[Cas9(TadA*8)]-[cytidine deaminase]-COOH;
NH$_2$-[cytidine deaminase]-[Cas9(TadA*8)]-COOH;
NH$_2$-[Cas9(cytidine deaminase)]-[TadA*8]-COOH; or
NH$_2$-[TadA*8]-[Cas9(cytidine deaminase)]-COOH.

In some embodiments, the "-" used in the general architecture above indicates the presence of an optional linker.

The heterologous polypeptide (e.g., deaminase) can be inserted in the napDNAbp (e.g., Cas9 or Cas12 (e.g., Cas12b/C2c1)) at a suitable location, for example, such that the napDNAbp retains its ability to bind the target polynucleotide and a guide nucleic acid. A deaminase (e.g., adenosine deaminase, cytidine deaminase, or adenosine deaminase and cytidine deaminase) can be inserted into a napDNAbp without compromising function of the deaminase (e.g., base editing activity) or the napDNAbp (e.g., ability to bind to target nucleic acid and guide nucleic acid). A deaminase (e.g., adenosine deaminase, cytidine deaminase, or adenosine deaminase and cytidine deaminase) can be inserted in the napDNAbp at, for example, a disordered region or a region comprising a high temperature factor or B-factor as shown by crystallographic studies. Regions of a protein that are less ordered, disordered, or unstructured, for example solvent exposed regions and loops, can be used for insertion without compromising structure or function. A deaminase (e.g., adenosine deaminase, cytidine deaminase, or adenosine deaminase and cytidine deaminase) can be inserted in the napDNAbp in a flexible loop region or a solvent-exposed region. In some embodiments, the deaminase (e.g., adenosine deaminase, cytidine deaminase, or adenosine deaminase and cytidine deaminase) is inserted in a flexible loop of the Cas9 or the Cas12b/C2c1 polypeptide.

In some embodiments, the insertion location of a deaminase (e.g., adenosine deaminase, cytidine deaminase, or adenosine deaminase and cytidine deaminase) is determined by B-factor analysis of the crystal structure of Cas9 polypeptide. In some embodiments, the deaminase (e.g., adenosine deaminase, cytidine deaminase, or adenosine deaminase and cytidine deaminase) is inserted in regions of the Cas9 polypeptide comprising higher than average B-factors (e.g., higher B factors compared to the total protein or the protein domain comprising the disordered region). B-factor or temperature factor can indicate the fluctuation of atoms from their average position (for example, as a result of temperature-dependent atomic vibrations or static disorder in a crystal lattice). A high B-factor (e.g., higher than average B-factor) for backbone atoms can be indicative of a region with relatively high local mobility. Such a region can be used for inserting a deaminase without compromising structure or function. A deaminase (e.g., adenosine deaminase, cytidine deaminase, or adenosine deaminase and cytidine deaminase) can be inserted at a location with a residue having a Cα atom with a B-factor that is 50%, 60%, 70%, 80%, 90%, 100%, 110%, 120%, 130%, 140%, 150%, 160%, 170%, 180%, 190%, 200%, or greater than 200% more than the average B-factor for the total protein. A deaminase (e.g., adenosine deaminase, cytidine deaminase, or adenosine deaminase and cytidine deaminase) can be inserted at a location with a residue having a Cα atom with a B-factor that is 50%, 60%, 70%, 80%, 90%, 100%, 110%, 120%, 130%, 140%, 150%, 160%, 170%, 180%, 190%, 200% or greater than 200% more than the average B-factor for a Cas9 protein domain comprising the residue. Cas9 polypeptide positions comprising a higher than average B-factor can include, for example, residues 768, 792, 1052, 1015, 1022, 1026, 1029, 1067, 1040, 1054, 1068, 1246, 1247, and 1248 as numbered in the above Cas9 reference sequence. Cas9 polypeptide regions comprising a higher than average B-factor can include, for example, residues 792-872, 792-906, and 2-791 as numbered in the above Cas9 reference sequence.

A heterologous polypeptide (e.g., deaminase) can be inserted in the napDNAbp at an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. In some embodiments, the heterologous polypeptide is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the above Cas9 reference sequence or corresponding amino acid positions thereof. In some embodiments, the heterologous polypeptide is inserted between amino acid positions 769-770, 792-793, 793-794, 1016-1017, 1023-1024, 1027-1028, 1030-1031, 1041-1042, 1053-1054, 1055-1056, 1068-1069, 1069-1070, 1248-1249, or 1249-1250 as numbered in the above Cas9 reference sequence or corresponding amino acid positions thereof. In some embodiments, the heterologous polypeptide replaces an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. It should be understood that the reference to the above Cas9 reference sequence with respect to insertion positions is for illustrative purposes. The insertions as discussed herein are not limited to the Cas9 polypeptide sequence of the above Cas9 reference sequence, but include insertion at corresponding locations in variant Cas9 polypeptides, for example a Cas9 nickase (nCas9), nuclease dead Cas9 (dCas9), a Cas9 variant lacking a nuclease domain, a truncated Cas9, or a Cas9 domain lacking partial or complete HNH domain.

A heterologous polypeptide (e.g., deaminase) can be inserted in the napDNAbp at an amino acid residue selected from the group consisting of: 768, 792, 1022, 1026, 1040, 1068, and 1247 as numbered in the above Cas9 reference sequence, or a corresponding amino acid residue in another Cas9 polypeptide. In some embodiments, the heterologous polypeptide is inserted between amino acid positions 768-769, 792-793, 1022-1023, 1026-1027, 1029-1030, 1040-1041, 1068-1069, or 1247-1248 as numbered in the above Cas9 reference sequence or corresponding amino acid positions thereof. In some embodiments, the heterologous polypeptide is inserted between amino acid positions 769-770, 793-794, 1023-1024, 1027-1028, 1030-1031, 1041-1042, 1069-1070, or 1248-1249 as numbered in the above Cas9 reference sequence or corresponding amino acid positions thereof. In some embodiments, the heterologous polypeptide replaces an amino acid residue selected from the group consisting of: 768, 792, 1022, 1026, 1040, 1068, and 1247 as numbered in the above Cas9 reference sequence, or a corresponding amino acid residue in another Cas9 polypeptide.

A heterologous polypeptide (e.g., deaminase) can be inserted in the napDNAbp at an amino acid residue as described herein, or a corresponding amino acid residue in another Cas9 polypeptide. In an embodiment, a heterologous polypeptide (e.g., deaminase) can be inserted in the napDNAbp at an amino acid residue selected from the group consisting of: 1002, 1003, 1025, 1052-1056, 1242-1247, 1061-1077, 943-947, 686-691, 569-578, 530-539, and 1060-1077 as numbered in the above Cas9 reference sequence, or a corresponding amino acid residue in another Cas9 polypeptide. The deaminase (e.g., adenosine deaminase, cytidine deaminase, or adenosine deaminase and cytidine deaminase) can be inserted at the N-terminus or the C-terminus of the residue or replace the residue. In some embodiments, the deaminase (e.g., adenosine deaminase, cytidine deaminase, or adenosine deaminase and cytidine deaminase) is inserted at the C-terminus of the residue.

In some embodiments, an adenosine deaminase (e.g., TadA) is inserted at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, an adenosine deaminase (e.g., TadA) is inserted in place of residues 792-872, 792-906, or 2-791 as numbered in the above Cas9 reference sequence, or a corresponding amino acid residue in another Cas9 polypeptide. In some embodiments, the adenosine deaminase is inserted at the N-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted at the C-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted to replace an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

In some embodiments, a CBE (e.g., APOBEC1) is inserted at an amino acid residue selected from the group consisting of: 1016, 1023, 1029, 1040, 1069, and 1247 as numbered in the above Cas9 reference sequence, or a corresponding amino acid residue in another Cas9 polypeptide. In some embodiments, the ABE is inserted at the N-terminus of an amino acid selected from the group consisting of: 1016, 1023, 1029, 1040, 1069, and 1247 as numbered in the above Cas9 reference sequence, or a corresponding amino acid residue in another Cas9 polypeptide. In some embodiments, the ABE is inserted at the C-terminus of an amino acid selected from the group consisting of: 1016, 1023, 1029, 1040, 1069, and 1247 as numbered in the above Cas9 reference sequence, or a corresponding amino acid residue in another Cas9 polypeptide. In some embodiments, the ABE is inserted to replace an amino acid selected from the group consisting of: 1016, 1023, 1029, 1040, 1069, and 1247 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 768 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 768 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 791 or is inserted at amino acid residue 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid 791, or is inserted to replace amino acid 792, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1016 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1016 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1022, or is inserted at amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1022 or is inserted at the N-terminus of amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1022 or is inserted at the C-terminus of amino acid residue 1023, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1022, or is inserted to replace amino acid residue 1023, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1026, or is inserted at amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1026 or is inserted at the N-terminus of amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1026 or is inserted at the C-terminus of amino acid residue 1029, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1026, or is inserted to replace amino acid residue 1029, as numbered in the above Cas9 reference sequence, or corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1040 as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1040 as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1052, or is inserted at amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1052 or is inserted at the N-terminus of amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1052 or is inserted at the C-terminus of amino acid residue 1054, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1052, or is inserted to replace amino acid residue 1054, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1067, or is inserted at amino acid residue 1068, or is inserted at amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1067 or is inserted at the N-terminus of amino acid residue 1068 or is inserted at the N-terminus of amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1067 or is inserted at the C-terminus of amino acid residue 1068 or is inserted at the C-terminus of amino acid residue 1069, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1067, or is inserted to replace amino acid residue 1068, or is inserted to replace amino acid residue 1069, as numbered in the above Cas9 reference sequence, or a corresponding amino acid residue in another Cas9 polypeptide.

In some embodiments, the deaminase (e.g., adenosine deaminase, cytidine deaminase, or adenosine deaminase and cytidine deaminase) is inserted at amino acid residue 1246, or is inserted at amino acid residue 1247, or is inserted at amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the N-terminus of amino acid residue 1246 or is inserted at the N-terminus of amino acid residue 1247 or is inserted at the N-terminus of amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted at the C-terminus of amino acid residue 1246 or is inserted at the C-terminus of amino acid residue 1247 or is inserted at the C-terminus of amino acid residue 1248, as numbered in the above Cas9 reference sequence, or a corresponding amino acid residue in another Cas9 polypeptide. In some embodiments, the deaminase (e.g., adenosine deaminase, cytidine deaminase, or adenosine deaminase and cytidine deaminase) is inserted to replace amino acid residue 1246, or is inserted to replace amino acid residue 1247, or is inserted to replace amino acid residue 1248, as numbered in the above Cas9 reference sequence, or a corresponding amino acid residue in another Cas9 polypeptide.

In some embodiments, a heterologous polypeptide (e.g., deaminase) is inserted in a flexible loop of a Cas9 polypeptide. The flexible loop portions can be selected from the group consisting of 530-537, 569-570, 686-691, 943-947, 1002-1025, 1052-1077, 1232-1247, or 1298-1300 as numbered in the above Cas9 reference sequence, or a corresponding amino acid residue in another Cas9 polypeptide. The flexible loop portions can be selected from the group consisting of: 1-529, 538-568, 580-685, 692-942, 948-1001, 1026-1051, 1078-1231, or 1248-1297 as numbered in the above Cas9 reference sequence, or a corresponding amino acid residue in another Cas9 polypeptide.

A heterologous polypeptide (e.g., adenine deaminase) can be inserted into a Cas9 polypeptide region corresponding to amino acid residues: 1017-1069, 1242-1247, 1052-1056, 1060-1077, 1002-1003, 943-947, 530-537, 568-579, 686-691, 1242-1247, 1298-1300, 1066-1077, 1052-1056, or 1060-1077 as numbered in the above Cas9 reference sequence, or a corresponding amino acid residue in another Cas9 polypeptide.

A heterologous polypeptide (e.g., adenine deaminase) can be inserted in place of a deleted region of a Cas9 polypeptide. The deleted region can correspond to an N-terminal or C-terminal portion of the Cas9 polypeptide. In some embodiments, the deleted region corresponds to residues 792-872 as numbered in the above Cas9 reference sequence, or a corresponding amino acid residue in another Cas9 polypeptide. In some embodiments, the deleted region corresponds to residues 792-906 as numbered in the above Cas9 reference sequence, or a corresponding amino acid residue in another Cas9 polypeptide. In some embodiments, the deleted region corresponds to residues 2-791 as numbered in the above Cas9 reference sequence, or a corresponding amino acid residue in another Cas9 polypeptide. In some embodiments, the deleted region corresponds to residues 1017-1069 as numbered in the above Cas9 reference sequence, or corresponding amino acid residues thereof.

Exemplary internal fusions base editors are provided in Table 10A below:

TABLE 10A

Insertion loci in Cas9 proteins

| BE ID | Modification | Other ID |
|---|---|---|
| IBE001 | Cas9 TadA ins 1015 | ISLAY01 |
| IBE002 | Cas9 TadA ins 1022 | ISLAY02 |
| IBE003 | Cas9 TadA ins 1029 | ISLAY03 |
| IBE004 | Cas9 TadA ins 1040 | ISLAY04 |
| IBE005 | Cas9 TadA ins 1068 | ISLAY05 |
| IBE006 | Cas9 TadA ins 1247 | ISLAY06 |
| IBE007 | Cas9 TadA ins 1054 | ISLAY07 |
| IBE008 | Cas9 TadA ins 1026 | ISLAY08 |
| IBE009 | Cas9 TadA ins 768 | ISLAY09 |
| IBE020 | delta HNH TadA 792 | ISLAY20 |

TABLE 10A-continued

Insertion loci in Cas9 proteins

| BE ID | Modification | Other ID |
|---|---|---|
| IBE021 | N-term fusion single TadA helix truncated 165-end | ISLAY21 |
| D3E029 | TadA-Circular Permutant116 ins1067 | ISLAY29 |
| D3E031 | TadA-Circular Permutant 136 ins1248 | ISLAY31 |
| D3E032 | TadA-Circular Permutant 136ins 1052 | ISLAY32 |
| D3E035 | delta 792-872 TadA ins | ISLAY35 |
| D3E036 | delta 792-906 TadA ins | ISLAY36 |
| D3E043 | TadA-Circular Permutant 65 ins1246 | ISLAY43 |
| D3E044 | TadA ins C-term truncate2 791 | ISLAY44 |

A heterologous polypeptide (e.g., deaminase) can be inserted within a structural or functional domain of a Cas9 polypeptide. A heterologous polypeptide (e.g., deaminase) can be inserted between two structural or functional domains of a Cas9 polypeptide. A heterologous polypeptide (e.g., deaminase) can be inserted in place of a structural or functional domain of a Cas9 polypeptide, for example, after deleting the domain from the Cas9 polypeptide. The structural or functional domains of a Cas9 polypeptide can include, for example, RuvC I, RuvC II, RuvC III, Rec1, Rec2, PI, or HNH.

In some embodiments, the Cas9 polypeptide lacks one or more domains selected from the group consisting of: RuvC I, RuvC II, RuvC III, Rec1, Rec2, PI, or HNH domain. In some embodiments, the Cas9 polypeptide lacks a nuclease domain. In some embodiments, the Cas9 polypeptide lacks an HNH domain. In some embodiments, the Cas9 polypeptide lacks a portion of the HNH domain such that the Cas9 polypeptide has reduced or abolished HNH activity. In some embodiments, the Cas9 polypeptide comprises a deletion of the nuclease domain, and the deaminase is inserted to replace the nuclease domain. In some embodiments, the HNH domain is deleted and the deaminase is inserted in its place. In some embodiments, one or more of the RuvC domains is deleted and the deaminase is inserted in its place.

A fusion protein comprising a heterologous polypeptide can be flanked by a N-terminal and a C-terminal fragment of a napDNAbp. In some embodiments, the fusion protein comprises a deaminase flanked by a N-terminal fragment and a C-terminal fragment of a Cas9 polypeptide. The N terminal fragment or the C terminal fragment can bind the target polynucleotide sequence. The C-terminus of the N terminal fragment or the N-terminus of the C terminal fragment can comprise a part of a flexible loop of a Cas9 polypeptide. The C-terminus of the N terminal fragment or the N-terminus of the C terminal fragment can comprise a part of an alpha-helix structure of the Cas9 polypeptide. The N-terminal fragment or the C-terminal fragment can comprise a DNA binding domain. The N-terminal fragment or the C-terminal fragment can comprise a RuvC domain. The N-terminal fragment or the C-terminal fragment can comprise an HNH domain. In some embodiments, neither of the N-terminal fragment and the C-terminal fragment comprises an HNH domain.

In some embodiments, the C-terminus of the N terminal Cas9 fragment comprises an amino acid that is in proximity to a target nucleobase when the fusion protein deaminates the target nucleobase. In some embodiments, the N-terminus of the C terminal Cas9 fragment comprises an amino acid that is in proximity to a target nucleobase when the fusion protein deaminates the target nucleobase. The insertion location of different deaminases can be different in order to have proximity between the target nucleobase and an amino acid in the C-terminus of the N terminal Cas9 fragment or the N-terminus of the C terminal Cas9 fragment. For example, the insertion position of an ABE can be at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

The N-terminal Cas9 fragment of a fusion protein (i.e. the N-terminal Cas9 fragment flanking the deaminase in a fusion protein) can comprise the N-terminus of a Cas9 polypeptide. The N-terminal Cas9 fragment of a fusion protein can comprise a length of at least about: 100, 200, 300, 400, 500, 600, 700, 800, 900, 1000, 1100, 1200, or 1300 amino acids. The N-terminal Cas9 fragment of a fusion protein can comprise a sequence corresponding to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide.

The C-terminal Cas9 fragment of a fusion protein (i.e. the C-terminal Cas9 fragment flanking the deaminase in a fusion protein) can comprise the C-terminus of a Cas9 polypeptide. The C-terminal Cas9 fragment of a fusion protein can comprise a length of at least about: 100, 200, 300, 400, 500, 600, 700, 800, 900, 1000, 1100, 1200, or 1300 amino acids. The C-terminal Cas9 fragment of a fusion protein can comprise a sequence corresponding to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide.

The N-terminal Cas9 fragment and C-terminal Cas9 fragment of a fusion protein taken together may not correspond to a full-length naturally occurring Cas9 polypeptide sequence, for example, as set forth in the above Cas9 reference sequence.

The fusion protein described herein can effect targeted deamination with reduced deamination at non-target sites (e.g., off-target sites), such as reduced genome wide spurious deamination. The fusion protein described herein can effect targeted deamination with reduced bystander deamination at non-target sites. The undesired deamination or off-target deamination can be reduced by at least 30%, at least 40%, at least 50%, at least 60%, at least 70%, at least 80%, at least 90%, at least 95%, or at least 99% compared with, for example, an end terminus fusion protein comprising the deaminase fused to a N terminus or a C terminus of a Cas9 polypeptide. The undesired deamination or off-target deamination can be reduced by at least one-fold, at least two-fold, at least three-fold, at least four-fold, at least five-fold, at least tenfold, at least fifteen fold, at least twenty fold, at least thirty fold, at least forty fold, at least fifty fold, at least 60 fold, at least 70 fold, at least 80 fold, at least 90 fold, or at least hundred fold, compared with, for example, an end terminus fusion protein comprising the deaminase fused to a N terminus or a C terminus of a Cas9 polypeptide.

In some embodiments, the deaminase (e.g., adenosine deaminase, cytidine deaminase, or adenosine deaminase and cytidine deaminase) of the fusion protein deaminates no more than two nucleobases within the range of an R-loop. In some embodiments, the deaminase of the fusion protein deaminates no more than three nucleobases within the range of the R-loop. In some embodiments, the deaminase of the fusion protein deaminates no more than 2, 3, 4, 5, 6, 7, 8, 9, or 10 nucleobases within the range of the R-loop. An R-loop is a three-stranded nucleic acid structure including a DNA:RNA hybrid, a DNA:DNA or an RNA: RNA complementary structure and the associated with single-stranded DNA. As used herein, an R-loop may be formed when a target polynucleotide is contacted with a CRISPR complex or a base editing complex, wherein a portion of a guide polynucleotide, e.g. a guide RNA, hybridizes with and displaces with a portion of a target polynucleotide, e.g. a target DNA. In some embodiments, an R-loop comprises a hybridized region of a spacer sequence and a target DNA complementary sequence. An R-loop region may be of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleobase pairs in length. In some embodiments, the R-loop region is about 20 nucleobase pairs in length. It should be understood that, as used herein, an R-loop region is not limited to the target DNA strand that hybridizes with the guide polynucleotide. For example, editing of a target nucleobase within an R-loop region may be to a DNA strand that comprises the complementary strand to a guide RNA, or may be to a DNA strand that is the opposing strand of the strand complementary to the guide RNA. In some embodiments, editing in the region of the R-loop comprises editing a nucleobase on non-complementary strand (protospacer strand) to a guide RNA in a target DNA sequence.

The fusion protein described herein can effect target deamination in an editing window different from canonical base editing. In some embodiments, a target nucleobase is from about 1 to about 20 bases upstream of a PAM sequence in the target polynucleotide sequence. In some embodiments, a target nucleobase is from about 2 to about 12 bases upstream of a PAM sequence in the target polynucleotide sequence. In some embodiments, a target nucleobase is from about 1 to 9 base pairs, about 2 to 10 base pairs, about 3 to 11 base pairs, about 4 to 12 base pairs, about 5 to 13 base pairs, about 6 to 14 base pairs, about 7 to 15 base pairs, about 8 to 16 base pairs, about 9 to 17 base pairs, about 10 to 18 base pairs, about 11 to 19 base pairs, about 12 to 20 base pairs, about 1 to 7 base pairs, about 2 to 8 base pairs, about 3 to 9 base pairs, about 4 to 10 base pairs, about 5 to 11 base pairs, about 6 to 12 base pairs, about 7 to 13 base pairs, about 8 to 14 base pairs, about 9 to 15 base pairs, about 10 to 16 base pairs, about 11 to 17 base pairs, about 12 to 18 base pairs, about 13 to 19 base pairs, about 14 to 20 base pairs, about 1 to 5 base pairs, about 2 to 6 base pairs, about 3 to 7 base pairs, about 4 to 8 base pairs, about 5 to 9 base pairs, about 6 to 10 base pairs, about 7 to 11 base pairs, about 8 to 12 base pairs, about 9 to 13 base pairs, about 10 to 14 base pairs, about 11 to 15 base pairs, about 12 to 16 base pairs, about 13 to 17 base pairs, about 14 to 18 base pairs, about 15 to 19 base pairs, about 16 to 20 base pairs, about 1 to 3 base pairs, about 2 to 4 base pairs, about 3 to 5 base pairs, about 4 to 6 base pairs, about 5 to 7 base pairs, about 6 to 8 base pairs, about 7 to 9 base pairs, about 8 to 10 base pairs, about 9 to 11 base pairs, about 10 to 12 base pairs, about 11 to 13 base pairs, about 12 to 14 base pairs, about 13 to 15 base pairs, about 14 to 16 base pairs, about 15 to 17 base pairs, about 16 to 18 base pairs, about 17 to 19 base pairs, about 18 to 20 base pairs away or upstream of the PAM sequence. In some embodiments, a target nucleobase is about 1, 2, 3, 4, 5, 6, 7, 8, 9, 10, 11, 12, 13, 14, 15, 16, 17, 18, 19, 20, or more base pairs away from or upstream of the PAM sequence. In some embodiments, a target nucleobase is about 1, 2, 3, 4, 5, 6, 7, 8, or 9 base pairs upstream of the PAM sequence. In some embodiments, a target nucleobase is about 2, 3, 4, or 6 base pairs upstream of the PAM sequence.

The fusion protein can comprise more than one heterologous polypeptide. For example, the fusion protein can additionally comprise one or more UGI domains and/or one or more nuclear localization signals. The two or more heterologous domains can be inserted in tandem. The two or more heterologous domains can be inserted at locations such that they are not in tandem in the NapDNAbp.

A fusion protein can comprise a linker between the deaminase and the napDNAbp polypeptide. The linker can be a peptide or a non-peptide linker. For example, the linker can be an XTEN, (GGGS)n (SEQ ID NO: 189), (GGGGS)n (SEQ ID NO: 190), (G)n, (EAAAK)n (SEQ ID NO: 191), (GGS)n, SGSETPGTSESATPES (SEQ ID NO: 64). In some embodiments, the fusion protein comprises a linker between the N-terminal Cas9 fragment and the deaminase. In some embodiments, the fusion protein comprises a linker between the C-terminal Cas9 fragment and the deaminase. In some embodiments, the N-terminal and C-terminal fragments of napDNAbp are connected to the deaminase with a linker. In some embodiments, the N-terminal and C-terminal fragments are joined to the deaminase domain without a linker. In some embodiments, the fusion protein comprises a linker between the N-terminal Cas9 fragment and the deaminase, but does not comprise a linker between the C-terminal Cas9 fragment and the deaminase. In some embodiments, the fusion protein comprises a linker between the C-terminal Cas9 fragment and the deaminase, but does not comprise a linker between the N-terminal Cas9 fragment and the deaminase.

In some embodiments, the napDNAbp in the fusion protein is a Cas12 polypeptide, e.g., Cas12b/C2c1, or a fragment thereof. The Cas12 polypeptide can be a variant Cas12 polypeptide. In other embodiments, the N- or C-terminal fragments of the Cas12 polypeptide comprise a nucleic acid programmable DNA binding domain or a RuvC domain. In other embodiments, the fusion protein contains a linker between the Cas12 polypeptide and the catalytic domain. In other embodiments, the amino acid sequence of the linker is GGSGGS (SEQ ID NO: 203) or GSSGSETPGTSESATPESSG (SEQ ID NO: 204). In other embodiments, the linker is a rigid linker. In other embodiments of the above aspects, the linker is encoded by GGAGGCTCTGGAGGAAGC (SEQ ID NO: 205) or GGCTCTTCTGGATCT-GAAACACCTGGCACAAGCGAGAGCGCCACCCCT-GAGAGCTCTGGC (SEQ ID NO: 206).

Fusion proteins comprising a heterologous catalytic domain flanked by N- and C-terminal fragments of a Cas12 polypeptide are also useful for base editing in the methods as described herein. Fusion proteins comprising Cas12 and one or more deaminase domains, e.g., adenosine deaminase, or comprising an adenosine deaminase domain flanked by Cas12 sequences are also useful for highly specific and efficient base editing of target sequences. In an embodiment, a chimeric Cas12 fusion protein contains a heterologous catalytic domain (e.g., adenosine deaminase, cytidine deaminase, or adenosine deaminase and cytidine deaminase) inserted within a Cas12 polypeptide. In some embodiments, the fusion protein comprises an adenosine deaminase domain and a cytidine deaminase domain inserted within a Cas12. In some embodiments, an adenosine deaminase is fused within Cas12 and a cytidine deaminase is fused to the C-terminus. In some embodiments, an adenosine deaminase is fused within Cas12 and a cytidine deaminase fused to the N-terminus. In some embodiments, a cytidine deaminase is fused within Cas12 and an adenosine deaminase is fused to the C-terminus. In some embodiments, a cytidine deaminase is fused within Cas12 and an adenosine deaminase fused to the N-terminus. Exemplary structures of a fusion protein with an adenosine deaminase and a cytidine deaminase and a Cas12 are provided as follows:

NH$_2$-[Cas12(adenosine deaminase)]-[cytidine deaminase]-COOH;

NH$_2$-[cytidine deaminase]-[Cas12(adenosine deaminase)]-COOH;

NH$_2$-[Cas12(cytidine deaminase)]-[adenosine deaminase]-COOH; or

NH$_2$-[adenosine deaminase]-[Cas12(cytidine deaminase)]-COOH;

In some embodiments, the "-" used in the general architecture above indicates the presence of an optional linker.

In various embodiments, the catalytic domain has DNA modifying activity (e.g., deaminase activity), such as adenosine deaminase activity. In some embodiments, the adenosine deaminase is a TadA (e.g., TadA7.10). In some embodiments, the TadA is a TadA*8. In some embodiments, a TadA*8 is fused within Cas12 and a cytidine deaminase is fused to the C-terminus. In some embodiments, a TadA*8 is fused within Cas12 and a cytidine deaminase fused to the N-terminus. In some embodiments, a cytidine deaminase is fused within Cas12 and a TadA*8 is fused to the C-terminus. In some embodiments, a cytidine deaminase is fused within Cas12 and a TadA*8 fused to the N-terminus. Exemplary structures of a fusion protein with a TadA*8 and a cytidine deaminase and a Cas12 are provided as follows:

N-[Cas12(TadA*8)]-[cytidine deaminase]-C;
N-[cytidine deaminase]-[Cas12(TadA*8)]-C;
N-[Cas12(cytidine deaminase)]-[TadA*8]-C; or
N-[TadA*8]-[Cas12(cytidine deaminase)]-C.

In some embodiments, the "-" used in the general architecture above indicates the presence of an optional linker.

In other embodiments, the fusion protein contains one or more catalytic domains. In other embodiments, at least one of the one or more catalytic domains is inserted within the Cas12 polypeptide or is fused at the Cas12 N-terminus or C-terminus. In other embodiments, at least one of the one or more catalytic domains is inserted within a loop, an alpha helix region, an unstructured portion, or a solvent accessible portion of the Cas12 polypeptide. In other embodiments, the Cas12 polypeptide is Cas12a, Cas12b, Cas12c, Cas12d, Cas12e, Cas12g, Cas12h, or Cas12i. In other embodiments, the Cas12 polypeptide has at least about 85% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 90% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 95% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide contains or consists essentially of a fragment of *Bacillus hisashii* Cas12b, *Bacillus thermoamylovorans* Cas12b, *Bacillus* sp. V3-13 Cas12b, or *Alicyclobacillus acidiphilus* Cas12b.

In other embodiments, the catalytic domain is inserted between amino acid positions 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, or Cas12i. In other embodiments, the catalytic domain is inserted between amino acids P153 and S154 of BhCas12b. In other embodiments, the catalytic domain is inserted between amino acids K255 and E256 of BhCas12b. In other embodiments, the catalytic domain is inserted between amino acids D980 and G981 of BhCas12b. In other embodiments, the catalytic domain is inserted between amino acids K1019 and L1020 of BhCas12b. In other embodiments, the catalytic domain is inserted between amino acids F534 and P535 of BhCas12b. In other embodiments, the catalytic domain is inserted between amino acids K604 and G605 of BhCas12b. In other embodiments, the catalytic domain is inserted between amino acids H344 and F345 of BhCas12b. In other embodiments, catalytic domain is inserted between amino acid positions 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, or Cas12i. In other embodiments, the catalytic domain is inserted between amino acids P147 and D148 of BvCas12b. In other embodiments, the catalytic domain is inserted between amino acids G248 and G249 of BvCas12b. In other embodiments, the catalytic domain is inserted between amino acids P299 and E300 of BvCas12b. In other embodiments, the catalytic domain is inserted between amino acids G991 and E992 of BvCas12b. In other embodiments, the catalytic domain is inserted between amino acids K1031 and M1032 of BvCas12b. In other embodiments, the catalytic domain is inserted between amino acid positions 157 and 158, 258 and 259, 310 and 311, 1008 and 1009, or 1044 and 1045 of AaCas12b or a corresponding amino acid residue of Cas12a, Cas12c, Cas12d, Cas12e, Cas12g, Cas12h, or Cas12i. In other embodiments, the catalytic domain is inserted between amino acids P157 and G158 of AaCas12b. In other embodiments, the catalytic domain is inserted between amino acids V258 and G259 of AaCas12b. In other embodiments, the catalytic domain is inserted between amino acids D310 and P311 of AaCas12b. In other embodiments, the catalytic domain is inserted between amino acids G1008 and E1009 of AaCas12b. In other embodiments, the catalytic domain is inserted between amino acids G1044 and K1045 at of AaCas12b.

In other embodiments, the fusion protein contains a nuclear localization signal (e.g., a bipartite nuclear localization signal). In other embodiments, the amino acid sequence of the nuclear localization signal is MAPKKKRKVGIHGVPAA (SEQ ID NO: 207). In other embodiments of the above aspects, the nuclear localization signal is encoded by the following sequence: ATGGCCC-CAAAGAAGAAGCGGAAGGTCGGTATCCACG-GAGTCCCAGCAGCC (SEQ ID NO: 208). In other embodiments, the Cas12b polypeptide contains a mutation that silences the catalytic activity of a RuvC domain. In other embodiments, the Cas12b polypeptide contains D574A, D829A and/or D952A mutations. In other embodiments, the fusion protein further contains a tag (e.g., an influenza hemagglutinin tag).

In some embodiments, the fusion protein comprises a napDNAbp domain (e.g., Cas12-derived domain) with an internally fused nucleobase editing domain (e.g., all or a portion of a deaminase domain, e.g., an adenosine deaminase domain). In some embodiments, the napDNAbp is a Cas12b. In some embodiments, the base editor comprises a BhCas12b domain with an internally fused TadA*8 domain inserted at the loci provided in the below Table.

TABLE 10B

Insertion loci in Cas12b proteins

| BhCas12b | Insertion site | Inserted between aa |
|---|---|---|
| position 1 | 153 | PS |
| position 2 | 255 | KE |
| position 3 | 306 | DE |
| position 4 | 980 | DG |
| position 5 | 1019 | KL |
| position 6 | 534 | FP |
| position 7 | 604 | KG |
| position 8 | 344 | HF |

| BvCas12b | Insertion site | Inserted between aa |
|---|---|---|
| position 1 | 147 | PD |
| position 2 | 248 | GG |
| position 3 | 299 | PE |
| position 4 | 991 | GE |
| position 5 | 1031 | KM |

| AaCas12b | Insertion site | Inserted between aa |
|---|---|---|
| position 1 | 157 | PG |
| position 2 | 258 | VG |
| position 3 | 310 | DP |
| position 4 | 1008 | GE |
| position 5 | 1044 | GK |

By way of nonlimiting example, an adenosine deaminase (e.g., ABE8.13) may be inserted into a BhCas12b to produce a fusion protein (e.g., ABE8.13-BhCas12b) that effectively edits a nucleic acid sequence.

In some embodiments, the base editing system described herein comprises an ABE with TadA inserted into a Cas9. Sequences of relevant ABEs with TadA inserted into a Cas9 are provided.

```
101 Cas9 TadAins 1015
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVGSSGSETPGTSESATPESSGSEVEFSHEYWMRHAL
TLAKRARDEREVPVGAVLVLNNRVIGEGWNRAIGLHDPTAHAEIMALRQG
GLVMQNYRLIDATLYVTFEPCVMCAGAMIHSRIGRVVFGVRNAKTGAAGS
LMDVLHYPGMNHRVEITEGILADECAALLCYFFRMPRQVFNAQKKAQSST
DYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 209)

102 Cas9 TadAins 1022
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
```

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIGSSGSETPGTSESATPESSGSEVEFSHE

YWMRHALTLAKRARDEREVPVGAVLVLNNRVIGEGWNRAIGLHDPTAHAE

IMALRQGGLVMQNYRLIDATLYVTFEPCVMCAGAMIHSRIGRVVFGVRNA

KTGAAGSLMDVLHYPGMNHRVEITEGILADECAALLCYFFRMPRQVFNAQ

KKAQSSTDAKSEQEIGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD (SEQ ID NO: 210)

103 Cas9 TadAins 1029
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIV+32TLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSGSSGSETPGTSESATPESSGS

EVEFSHEYWMRHALTLAKRARDEREVPVGAVLVLNNRVIGEGWNRAIGLH

DPTAHAEIMALRQGGLVMQNYRLIDATLYVTFEPCVMCAGAMIHSRIGRV

VFGVRNAKTGAAGSLMDVLHYPGMNHRVEITEGILADECAALLCYFFRMP

RQVFNAQKKAQSSTDGKATAKYFFYSNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD (SEQ ID NO: 211)

103 Cas9 TadAins 1040
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIV+32TLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSGSSGSETPGT

SESATPESSGSEVEFSHEYWMRHALTLAKRARDEREVPVGAVLVLNNRVI

GEGWNRAIGLHDPTAHAEIMALRQGGLVMQNYRLIDATLYVTFEPCVMCA

GAMIHSRIGRVVFGVRNAKTGAAGSLMDVLHYPGMNHRVEITEGILADEC

AALLCYFFRMPRQVFNAQKKAQSSTDNIMNFFKTEITLANGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD (SEQ ID NO: 212)

105 Cas9 TadAins 1068
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGEGSSGSETPGTSESATPESSGSEVEFSHEYWMR
HALTLAKRARDEREVPVGAVLVLNNRVIGEGWNRAIGLHDPTAHAEIMAL
RQGGLVMQNYRLIDATLYVTFEPCVMCAGAMIHSRIGRVVFGVRNAKTGA
AGSLMDVLHYPGMNHRVEITEGILADECAALLCYFFRMPRQVFNAQKKAQ
SSTDTGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKYTSTKEVLDATLIHQSITGLYETRIDLSQ
LGGD (SEQ ID NO: 213)

106 Cas9 TadAins 1247
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGGSS
GSETPGTSESATPESSGSEVEFSHEYWMRHALTLAKRARDEREVPVGAVL
VLNNRVIGEGWNRAIGLHDPTAHAEIMALRQGGLVMQNYRLIDATLYVTF
EPCVMCAGAMIHSRIGRVVFGVRNAKTGAAGSLMDVLHYPGMNHRVEITE
GILADECAALLCYFFRMPRQVFNAQKKAQSSTDSPEDNEQKQLFVEQHKH
YLDEIIEQISEFSKRVILADANLDKVLSAYNKHRDKPIREQAENIIHLFT
LTNLGAPAAFKYFDTTIDRKYTSTKEVLDATLIHQSITGLYETRIDLSQ
LGGD (SEQ ID NO: 214)

107 Cas9 TadAins 1054
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGSSGSETPGTSESATPESSGSEVEFSHEYWMRHALTLAKRARDERE
VPVGAVLVLNNRVIGEGWNRAIGLHDPTAHAEIMALRQGGLVMQNYRLID
ATLYVTFEPCVMCAGAMIHSRIGRVVFGVRNAKTGAAGSLMDVLHYPGMN
HRVEITEGILADECAALLCYFFRMPRQVFNAQKKAQSSTDGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 215)

108 Cas9 TadAins 1026
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEGSSGSETPGTSESATPESSGSEVE
FSHEYWMRHALTLAKRARDEREVPVGAVLVLNNRVIGEGWNRAIGLHDPT
AHAEIMALRQGGLVMQNYRLIDATLYVTFEPCVMCAGAMIHSRIGRVVFG
VRNAKTGAAGSLMDVLHYPGMNHRVEITEGILADECAALLCYFFRMPRQV
FNAQKKAQSSTDQEIGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 216)

109 Cas9 TadAins 768
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQGSSGSETPGTSESATPESSGSEVEFSHEYWMR
HALTLAKRARDEREVPVGAVLVLNNRVIGEGWNRAIGLHDPTAHAEIMAL
RQGGLVMQNYRLIDATLYVTFEPCVMCAGAMIHSRIGRVVFGVRNAKTGA
AGSLMDVLHYPGMNHRVEITEGILADECAALLCYFFRMPRTTQKGQKNSR
ERMKRIEEGIKELGSQILKEHPVENTQLQNEKLYLYYLQNGRDMYVDQEL
DINRLSDYDVDHIVPQSFLKDDSIDNKVLTRSDKNRGKSDNVPSEEVVKK
MKNYWRQLLNAKLITQRKFDNLTKAERGGLSELDKAGFIKRQLVETRQIT
KHVAQILDSRMNTKYDENDKLIREVKVITLKSKLVSDFRKDFQFYKVREI
NNYHHAHDAYLNAVVGTALIKKYPKLESEFVYGDYKVYDVRKMIAKSEQE
IGKATAKYFFYSNIMNFFKTEITLANGEIRKRPLIETNGETGEIVWDKGR
DFATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKNP
IDFLEAKGYKEVKKDLIIKLPKYSLFELENGRKRMLASAGELQKGNELAL
PSKYVNFLYLASHYEKLKGSPEDNEQKQLFVEQHKHYLDEIIEQISEFSK
RVILADANLDKVLSAYNKHRDKPIREQAENIIHLFTLTNLGAPAAFKYFD
TTIDRKRYTSTKEVLDATLIHQSITGLYETRIDLSQLGGD
(SEQ ID NO: 217)

110.1 Cas9 TadAins 1250
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPG
SSGSETPGTSESATPESSGSEVEFSHEYWMRHALTLAKRARDEREVPVGA
VLVLNNRVIGEGWNRAIGLHDPTAHAEIMALRQGGLVMQNYRLIDATLYV
TFEPCVMCAGAMIHSRIGRVVFGVRNAKTGAAGSLMDVLHYPGMNHRVEI
TEGILADECAALLCYFFRMPREDNEQKQLFVEQHKYLDEIIEQISEFSK
RVILADANLDKVLSAYNKHRDKPIREQAENIIHLFTLTNLGAPAAFKYFD
TTIDRKRYTSTKEVLDATLIHQSITGLYETRIDLSQLGGD
(SEQ ID NO: 218)

110.2 Cas9 TadAins 1250
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPG
SSGSSGSETPGTSESATPESSGSEVEFSHEYWMRHALTLAKRARDEREVP
VGAVLVLNNRVIGEGWNRAIGLHDPTAHAEIMALRQGGLVMQNYRLIDAT
LYVTFEPCVMCAGAMIHSRIGRVVFGVRNAKTGAAGSLMDVLHYPGMNHR
VEITEGILADECAALLCYFFRMPREDNEQKQLFVEQHKYLDEIIEQISE
FSKRVILADANLDKVLSAYNKHRDKPIREQAENIIHLFTLTNLGAPAAFK
YFDTTIDRKRYTSTKEVLDATLIHQSITGLYETRIDLSQLGGD
(SEQ ID NO: 219)

110.3 Cas9 TadAins 1250
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP -continued
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPG
SSGSSGSETPGTSESATPESGSSSGSEVEFSHEYWMRHALTLAKRARDER
EVPVGAVLVLNNRVIGEGWNRAIGLHDPTAHAEIMALRQGGLVMQNYRLI
DATLYVTFEPCVMCAGAMIHSRIGRVVFGVRNAKTGAAGSLMDVLHYPGM
NHRVEITEGILADECAALLCYFFRMPREDNEQKQLFVEQHKHYLDEIIEQ
ISEFSKRVILADANLDKVLSAYNKHRDKPIREQAENIIHLFTLTNLGAPA
AFKYFDTTIDRKRYTSTKEVLDATLIHQSITGLYETRIDLSQLGGD
(SEQ ID NO: 220)

110.4 Cas9 TadAins 1250
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPG
SSGSSGSETPGTSESATPESGSSSGSEVEFSHEYWMRHALTLAKRARDER
EVPVGAVLVLNNRVIGEGWNRAIGLHDPTAHAEIMALRQGGLVMQNYRLI
DATLYVTFEPCVMCAGAMIHSRIGRVVFGVRNAKTGAAGSLMDVLHYPGM
NHRVEITEGILADECAALLCYFFRMRREDNEQKQLFVEQHKHYLDEIIEQ
ISEFSKRVILADANLDKVLSAYNKHRDKPIREQAENIIHLFTLTNLGAPA
AFKYFDTTIDRKRYTSTKEVLDATLIHQSITGLYETRIDLSQLGGD
(SEQ ID NO: 221)

110.5 Cas9 TadAins 1249
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSGS
SGSSGSETPGTSESATPESGSSSGSEVEFSHEYWMRHALTLAKRARDERE
VPVGAVLVLNNRVIGEGWNRAIGLHDPTAHAEIMALRQGGLVMQNYRLID
ATLYVTFEPCVMCAGAMIHSRIGRVVFGVRNAKTGAAGSLMDVLHYPGMN
HRVEITEGILADECAALLCYFFRMRRPEDNEQKQLFVEQHKHYLDEIIEQ
ISEFSKRVILADANLDKVLSAYNKHRDKPIREQAENIIHLFTLTNLGAPA
AFKYFDTTIDRKRYTSTKEVLDATLIHQSITGLYETRIDLSQLGGD
(SEQ ID NO: 222)

110.5 Cas9 TadAins delta 59-66 1250
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPG
SSGSSSGSETPGTSESATPESGSSSGSEVEFSHEYWMRHALTLAKRARDE
REVPVGAVLVLNNRVIGEGWNRAHAEIMALRQGGLVMQNYRLIDATLYVTFE
PCVMCAGAMIHSRIGRVVFGVRNAKTGAAGSLMDVLHYPGMNHRVEITEG
ILADECAALLCYFFRMPRQVFNAQKKAQSSTDEDNEQKQLFVEQHKHYLD
EIIEQISEFSKRVILADANLDKVLSAYNKHRDKPIREQAENIIHLFTLTN
LGAPAAFKYFDTTIDRKRYTSTKEVLDATLIHQSITGLYETRIDLSQLGG
D (SEQ ID NO: 223)

110.6 Cas9 TadAins 1251
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
GSSGSSSGSETPGTSESATPESGSSSGSEVEFSHEYWMRHALTLAKRARDE
REVPVGAVLVLNNRVIGEGWNRAIGLHDPTAHAEIMALRQGGLVMQNYRL
IDATLYVTFEPCVMCAGAMIHSRIGRVVFGVRNAKTGAAGSLMDVLHYPG
MNHRVEITEGILADECAALLCYFFRMRRDNEQKQLFVEQHKHYLDEIIEQ
ISEFSKRVILADANLDKVLSAYNKHRDKPIREQAENIIHLFTLTNLGAPA
AFKYFDTTIDRKRYTSTKEVLDATLIHQSITGLYETRIDLSQLGGD
(SEQ ID NO: 224)

110.7 Cas9 TadAins 1252
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP

```
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DGSSGSSGSETPGTSESATPESGSSSGSEVEFSHEYWMRHALTLAKRARD
EREVPVGAVLVLNNRVIGEGWNRAIGLHDPTAHAEIMALRQGGLVMQNYR
LIDATLYVTFEPCVMCAGAMIHSRIGRVVFGVRNAKTGAAGSLMDVLHYP
GMNHRVEITEGILADECAALLCYFFRMRRNEQKQLFVEQHKHYLDEIIEQ
ISEFSKRVILADANLDKVLSAYNKHRDKPIREQAENIIHLFTLTNLGAPA
AFKYFDTTIDRKRYTSTKEVLDATLIHQSITGLYETRIDLSQLGGD
(SEQ ID NO: 225)

110.8 Cas9 TadAins delta 59-66 C-truncate 1250
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPG
SSGSETPGTSESATPESSGSEVEFSHEYWMRHALTLAKRARDEREVPVGA
VLVLNNRVIGEGWNRAHAEIMALRQGGLVMQNYRLIDATLYVTFEPCVMC
AGAMIHSRIGRVVFGVRNAKTGAAGSLMDVLHYPGMNHRVEITEGILADE
CAALLCYFFRMPRQEDNEQKQLFVEQHKHYLDEIIEQISEFSKRVILADA
NLDKVLSAYNKHRDKPIREQAENIIHLFTLTNLGAPAAFKYFDTTIDRKR
YTSTKEVLDATLIHQSITGLYETRIDLSQLGGD (SEQ ID NO: 226)

111.1 Cas9 TadAins 997
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALSHE
YWMRHALTLAKRARDEREVPVGAVLVLNNRVIGEGWNRAIGLHDPTAHAE
IMALRQGGLVMQNYRLIDATLYVTFEPCVMCAGAMIHSRIGRVVFGVRNA
KTGAAGSLMDVLHYPGMNHRVEITEGILADECAALLCYFFRMPRQVFNAQ
KKAQSSTDGSSGSETPGTSESATPESSGIKKYPKLESEFVYGDYKVYDVR
KMIAKSEQEIGKATAKYFFYSNIMNFFKTEITLANGEIRKRPLIETNGET
GEIVWDKGRDFATVRKVLSMPQVNIVKKTEVQTGGFSKESILPKRNSDKL
IARKKDWDPKKYGGFDSPTVAYSVLVVAKVEKGKSKKLKSVKELLGITIM
ERSSFEKNPIDFLEAKGYKEVKKDLIIKLPKYSLFELENGRKRMLASAGE
LQKGNELALPSKYVNFLYLASHYEKLKGSPEDNEQKQLFVEQHKHYLDEI
IEQISEFSKRVILADANLDKVLSAYNKHRDKPIREQAENIIHLFTLTNLG
APAAFKYFDTTIDRKRYTSTKEVLDATLIHQSITGLYETRIDLSQLGGD
(SEQ ID NO: 227)
```

111.2 Cas9 TadAins 997
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALSHE
YWMRHALTLAKRARDEREVPVGAVLVLNNRVIGEGWNRAIGLHDPTAHAE
IMALRQGGLVMQNYRLIDATLYVTFEPCVMCAGAMIHSRIGRVVFGVRNA
KTGAAGSLMDVLHYPGMNHRVEITEGILADECAALLCYFFRMPRQVFNAQ
KKAQSSTDGSSGSSGSETPGTSESATPESSGGSSIKKYPKLESEFVYGDY
KVYDVRKMIAKSEQEIGKATAKYFFYSNIMNFFKTEITLANGEIRKRPLI
ETNGETGEIVWDKGRDFATVRKVLSMPQVNIVKKTEVQTGGFSKESILPK
RNSDKLIARKKDWDPKKYGGFDSPTVAYSVLVVAKVEKGKSKKLKSVKEL
LGITIMERSSFEKNPIDFLEAKGYKEVKKDLIIKLPKYSLFELENGRKRM
LASAGELQKGNELALPSKYVNFLYLASHYEKLKGSPEDNEQKQLFVEQHK
HYLDEIIEQISEFSKRVILADANLDKVLSAYNKHRDKPIREQAENIIHLF
TLTNLGAPAAFKYFDTTIDRKRYTSTKEVLDATLIHQSITGLYETRIDLS
QLGGD (SEQ ID NO: 228)

112 delta HNH TadA
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSEVEFSHE
YWMRHALTLAKRARDEREVPVGAVLVLNNRVIGEGWNRAIGLHDPTAHAE
IMALRQGGLVMQNYRLIDATLYVTFEPCVMCAGAMIHSRIGRVVFGVRNA
KTGAAGSLMDVLHYPGMNHRVEITEGILADECAALLCYFFRMPRQVFNAQ
KKAQSSTDGGLSELDKAGFIKRQLVETRQITKHVAQILDSRMNTKYDEND
KLIREVKVITLKSKLVSDFRKDFQFYKVREINNYHHAHDAYLNAVVGTAL
IKKYPKLESEFVYGDYKVYDVRKMIAKSEQEIGKATAKYFFYSNIMNFFK
TEITLANGEIRKRPLIETNGETGEIVWDKGRDFATVRKVLSMPQVNIVKK
TEVQTGGFSKESILPKRNSDKLIARKKDWDPKKYGGFDSPTVAYSVLVVA
KVEKGKSKKLKSVKELLGITIMERSSFEKNPIDFLEAKGYKEVKKDLIIK
LPKYSLFELENGRKRMLASAGELQKGNELALPSKYVNFLYLASHYEKLKG
SPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATL
IHQSITGLYETRIDLSQLGGD (SEQ ID NO: 229)

113 N-term single TadA helix trunc 165-end
MSEVEFSHEYWMRHALTLAKRARDEREVPVGAVLVLNNRVIGEGWNRAIG
LHDPTAHAEIMALRQGGLVMQNYRLIDATLYVTFEPCVMCAGAMIHSRIG
RVVFGVRNAKTGAAGSLMDVLHYPGMNHRVEITEGILADECAALLCYFFR
MPRSGGSSGGSSGSETPGTSESATPESSGGSSGGSDKKYSIGLAIGTNSV
GWAVITDEYKVPSKKFKVLGNTDRHSIKKNLIGALLFDSGETAEATRLKR
TARRRYTRRKNRICYLQEIFSNEMAKVDDSFFHRLEESFLVEEDKKHERH
PIFGNIVDEVAYHEKYPTIYHLRKKLVDSTDKADLRLIYLALAHMIKFRG
HFLIEGDLNPDNSDVDKLFIQLVQTYNQLFEENPINASGVDAKAILSARL
SKSRRLENLIAQLPGEKKNGLFGNLIALSLGLTPNFKSNFDLAEDAKLQL
SKDTYDDDLDNLLAQIGDQYADLFLAAKNLSDAILLSDILRVNTEITKAP
LSASMIKRYDEHHQDLTLLKALVRQQLPEKYKEIFFDQSKNGYAGYIDGG
ASQEEFYKFIKPILEKMDGTEELLVKLNREDLLRKQRTFDNGSIPHQIHL
GELHAILRRQEDFYPFLKDNREKIEKILTFRIPYYVGPLARGNSRFAWMT
RKSEETITPWNFEEVVDKGASAQSFIERMTNFDKNLPNEKVLPKHSLLYE
YFTVYNELTKVKYVTEGMRKPAFLSGEQKKAIVDLLFKTNRKVTVKQLKE
DYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKL
INGIRDKQSGKTILDFLKSDGFANRNFMQLIHDDSLTFKEDIQKAQVSGQ -continued GDSLHEHIANLAGSPAIKKGILQTVKVVDELVKVMGRHKPENIVIEMARE
NQTTQKGQKNSRERMKRIEEGIKELGSQILKEHPVENTQLQNEKLYLYYL
QNGRDMYVDQELDINRLSDYDVDHIVPQSFLKDDSIDNKVLTRSDKNRGK
SDNVPSEEVVKKMKNYWRQLLNAKLITQRKFDNLTKAERGGLSELDKAGF
IKRQLVETRQITKHVAQILDSRMNTKYDENDKLIREVKVITLKSKLVSDF
RKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETN
GETGEIVWDKGRDFATVRKVLSMPQVNIVKKTEVQTGGFSKESILPKRNS
DKLIARKKDWDPKKYGGFDSPTVAYSVLVVAKVEKGKSKKLKSVKELLGI
TIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYL
DEIIEQISEFSKRVILADANLDKVLSAYNKHRDKPIREQAENIIHLFTLT
NLGAPAAFKYFDTTIDRKRYTSTKEVLDATLIHQSITGLYETRIDLSQLG
GD (SEQ ID NO: 230)

114 N-term single TadA helix trunc 165-end delta
59-65
MSEVEFSHEYWMRHALTLAKRARDEREVPVGAVLVLNNRVIGEGWNRTAH
AEIMALRQGGLVMQNYRLIDATLYVTFEPCVMCAGAMIHSRIGRVVFGVR
NAKTGAAGSLMDVLHYPGMNHRVEITEGILADECAALLCYFFRMPRSGGS
SGGSSGSETPGTSESATPESSGGSSGGSDKKYSIGLAIGTNSVGWAVITD
EYKVPSKKFKVLGNTDRHSIKKNLIGALLFDSGETAEATRLKRTARRYT
RRKNRICYLQEIFSNEMAKVDDSFFHRLEESFLVEEDKKHERHPIFGNIV
DEVAYHEKPTIYHLRKKLVDSTDKADLRLIYLALAHMIKFRGHFLIEGD
LNPDNSDVDKLFIQLVQTYNQLFEENPINASGVDAKAILSARLSKSRRLE
NLIAQLPGEKKNGLFGNLIALSLGLTPNFKSNFDLAEDAKLQLSKDTYDD
DLDNLLAQIGDQYADLFLAAKNLSDAILLSDILRVNTEITKAPLSASMIK
RYDEHHQDLTLLKALVRQQLPEKYKEIFFDQSKNGYAGYIDGGASQEEFY
KFIKPILEKMDGTEELLVKLNREDLLRKQRTFDNGSIPHQIHLGELHAIL
RRQEDFYPFLKDNREKIEKILTFRIPYYVGPLARGNSRFAWMTRKSEETI
TPWNFEEVVDKGASAQSFIERMTNFDKNLPNEKVLPKHSLLYEYFTVYNE
LTKVKYVTEGMRKPAFLSGEQKKAIVDLLFKTNRKVTVKQLKEDYFKKIE
CFDSVEISGVEDRFNASLGTYHDLLKIIKDKDFLDNEENEDILEDIVLTL
TLFEDREMIEERLKTYAHLFDDKVMKQLKRRRYTGWGRLSRKLINGIRDK
QSGKTILDFLKSDGFANRNFMQLIHDDSLTFKEDIQKAQVSGQGDSLHEH
IANLAGSPAIKKGILQTVKVVDELVKVMGRHKPENIVIEMARENQTTQKG
QKNSRERMKRIEEGIKELGSQILKEHPVENTQLQNEKLYLYYLQNGRDMY
VDQELDINRLSDYDVDHIVPQSFLKDDSIDNKVLTRSDKNRGKSDNVPSE
EVVKKMKNYWRQLLNAKLITQRKFDNLTKAERGGLSELDKAGFIKRQLVE
TRQITKHVAQILDSRMNTKYDENDKLIREVKVITLKSKLVSDFRKDFQFY
KVREINNYHHAHDAYLNAVVGTALIKKYPKLESEFVYGDYKVYDVRKMIA
KSEQEIGKATAKYFFYSNIMNFFKTEITLANGEIRKRPLIETNGETGEIV
WDKGRDFATVRKVLSMPQVNIVKKTEVQTGGFSKESILPKRNSDKLIARK -continued KDWDPKKYGGFDSPTVAYSVLVVAKVEKGKSKKLKSVKELLGITIMERSS
FEKNPIDFLEAKGYKEVKKDLIIKLPKYSLFELENGRKRMLASAGELQKG
NELALPSKYVNFLYLASHYEKLKGSPEDNEQKQLFVEQHKHYLDEIIEQI
SEFSKRVILADANLDKVLSAYNKHRDKPIREQAENIIHLFTLTNLGAPAA
FKYFDTTIDRKRYTSTKEVLDATLIHQSITGLYETRIDLSQLGGD
(SEQ ID NO: 231)

115.1 Cas9 TadAins 1004
MDKKYSIGLAIGTNSVGWAVITDEYKVPSKKFKVLGNTDRHSIKKNLIGA
LLFDSGETAEATRLKRTARRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKGSSGSETPGTSESATPESSGGSEVEFSHEYWMRHALTLAKRARDEREV
PVGAVLVLNNRVIGEGWNRAIGLHDPTAHAEIMALRQGGLVMQNYRLIDA
TLYVTFEPCVMCAGAMIHSRIGRVVFGVRNAKTGAAGSLMDVLHYPGMNH
RVEITEGILADECAALLCYFFRMPRQLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD
(SEQ ID NO: 232)

115.2 Cas9 TadAins 1005
MDKKYSIGLAIGTNSVGWAVITDEYKVPSKKFKVLGNTDRHSIKKNLIGA
LLFDSGETAEATRLKRTARRYTRRKNRICYLQEIFSNEMAKVDDSFFHR -continued
```
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLGSSGSETPGTSESATPESSGSEVEFSHEYWMRHALTLAKRARDERE
VPVGAVLVLNNRVIGEGWNRAIGLHDPTAHAEIMALRQGGLVMQNYRLID
ATLYVTFEPCVMCAGAMIHSRIGRVVFGVRNAKTGAAGSLMDVLHYPGMN
HRVEITEGILADECAALLCYFFRMPRQESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD
(SEQ ID NO: 233)
115.3 Cas9 TadAins 1006
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLEGSSGSETPGTSESATPESSGSEVEFSHEYWMRHALTLAKRARDER
EVPVGAVLVLNNRVIGEGWNRAIGLHDPTAHAEIMALRQGGLVMQNYRLI
DATLYVTFEPCVMCAGAMIHSRIGRVVFGVRNAKTGAAGSLMDVLHYPGM
NHRVEITEGILADECAALLCYFFRMPRQSEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD
(SEQ ID NO: 234)
115.4 Cas9 TadAins 1007
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
```

```
REVKVITLKSKLVSDFRKDFQFYKVREINNYHHAHDAYLNAVVGTALIKK
YPKLESGSSGSETPGTSESATPESSGSEVEFSHEYWMRHALTLAKRARDE
REVPVGAVLVLNNRVIGEGWNRAIGLHDPTAHAEIMALRQGGLVMQNYRL
IDATLYVTFEPCVMCAGAMIHSRIGRVVFGVRNAKTGAAGSLMDVLHYPG
MNHRVEITEGILADECAALLCYFFRMPRQEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD
(SEQ ID NO: 235)

116.1 Cas9 TadAins C-term truncate2 792
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSSGSETPG
TSESATPESSGSEVEFSHEYWMRHALTLAKRARDEREVPVGAVLVLNNR V
IGEGWNRAIGLHDPTAHAEIMALRQGGLVMQNYRLIDATLYVTFEPCVM
CAGAMIHSRIGRVVFGVRNAKTGAAGSLMDVLHYPGMNHRVEITEGILAD
ECAALLCYFFRMPRQSQILKEHPVENTQLQNEKLYLYYLQNGRDMYVDQE
LDINRLSDYDVDHIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD
(SEQ ID NO: 236)

116.2 Cas9 TadAins C-term truncate2 791
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSSGSETPG
TSESATPESSGSEVEFSHEYWMRHALTLAKRARDEREVPVGAVLVLNNRV
IGEGWNRAIGLHDPTAHAEIMALRQGGLVMQNYRLIDATLYVTFEPCVMC
AGAMIHSRIGRVVFGVRNAKTGAAGSLMDVLHYPGMNHRVEITEGILADE
CAALLCYFFRMPRQSQILKEHPVENTQLQNEKLYLYYLQNGRDMYVDQE
LDINRLSDYDVDHIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD
(SEQ ID NO: 237)

116.3 Cas9 TadAins C-term truncate2 790
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
```

-continued

INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKEGSSGSETPGT
SESATPESSGSEVEFSHEYWMRHALTLAKRARDEREVPVGAVLVLNNRVI
GEGWNRAIGLHDPTAHAEIMALRQGGLVMQNYRLIDATLYVTFEPCVMCA
GAMIHSRIGRVVFGVRNAKTGAAGSLMDVLHYPGMNHRVEITEGILADEC
AALLCYFFRMPRQLGSQILKEHPVENTQLQNEKLYLYYLQNGRDMYVDQE
LDINRLSDYDVDHIVPQSFLKDDSIDNKVLTRSDKNRGKSDNVPSEEVVK
KMKNYWRQLLNAKLITQRKFDNLTKAERGGLSELDKAGFIKRQLVETRQI
TKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQ
EIGKATAKYFFYSNIMNFFKTEITLANGEIRKRPLIETNGETGEIVWDKG
RDFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEKN
PIDFLEAKGYKEVKKDLIIKLPKYSLFELENGRKRMLASAGELQKGNELA
LPSKYVNFLYLASHYEKLKGSPEDNEQKQLFVEQHKHYLDEIIEQISEFS
KRVILADANLDKVLSAYNKHRDKPIREQAENIIHLFTLTNLGAPAAFKYF
DTTIDRKRYTSTKEVLDATLIHQSITGLYETRIDLSQLGGD
(SEQ ID NO: 238)

117 Cas9 delta 1017-1069
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYSSGSEVEFSHEYWMRHALTLAKRARDEREVPVGA
VLVLNNRVIGEGWNRAIGLHDPTAHAEIMALRQGGLVMQNYRLIDATLYV
TFEPCVMCAGAMIHSRIGRVVFGVRNAKTGAAGSLMDVLHYPGMNHRVEI
TEGILADECAALLCYFFRMPRQVFNAQKKAQSSTDGEIVWDKGRDFATVR
KVLSMPQVNIVKKTEVQTGGFSKESILPKRNSDKLIARKKDWDPKKYGGF
DSPTVAYSVLVVAKVEKGKSKKLKSVKELLGITIMERSSFEKNPIDFLEA
KGYKEVKKDLIIKLPKYSLFELENGRKRMLASAGELQKGNELALPSKYVN
FLYLASHYEKLKGSPEDNEQKQLFVEQHKHYLDEIIEQISEFSKRVILAD
ANLDKVLSAYNKHRDKPIREQAENIIHLFTLTNLGAPAAFKYFDTTIDRK
RYTSTKEVLDATLIHQSITGLYETRIDLSQLGGD
(SEQ ID NO: 239)

118 Cas9 TadA-CP116ins 1067
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNMNHRVEITEGILADECAALLCYFFRMPRQVFNAQ -continued KKAQSSTDGSSGSETPGTSESATPESSGSEVEFSHEYWMRHALTLAKRAR
DEREVPVGAVLVLNNRVIGEGWNRAIGLHDPTAHAEIMALRQGGLVMQNY
RLIDATLYVTFEPCVMCAGAMIHSRIGRVVFGVRNAKTGAAGSLMDVLHY
PGGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 240)

119 Cas9 TadAins 701
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SGSSSGSETPGTSESATPESSGSEVEFSHEYWMRHALTLAKRARDEREVPV
GAVLVLNNRVIGEGWNRAIGLHDPTAHAEIMALRQGGLVMQNYRLIDATL
YVTFEPCVMCAGAMIHSRIGRVVFGVRNAKTGAAGSLMDVLHYPGMNHRV
E1TEGILADECAALLCYFFRMPRQVFNAQKKAQSSTDLTFKEDIQKAQVS
GQGDSLHEHIANLAGSPAIKKGILQTVKVVDELVKVMGRHKPENIVIEMA
RENQTTQKGQKNSRERMKRIEEGIKELGSQILKEHPVENTQLQNEKLYLY
YLQNGRDMYVDQELDINRLSDYDVDHIVPQSFLKDDSIDNKVLTRSDKNR
GKSDNVPSEEVVKKMKNYWRQLLNAKLITQRKFDNLTKAERGGLSELDKA
GFIKRQLVETRQITKHVAQILDSRMNTKYDENDKLIREVKVITLKSKLVS
DFRKDFQFYKVREINNYHHAHDAYLNAVVGTALIKKYPKLESEFVYGDYK
VYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 241)

120 Cas9 TadACP136ins 1248
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSMN
HRVEITEGILADECAALLCYFFRMPRQVFNAQKKAQSSTDGSSGSETPGT
SESATPESSGSEVEFSHEYWMRHALTLAKRARDEREVPVGAVLVLNNRVI
GEGWNRAIGLHDPTAHAEIMALRQGGLVMQNYRLIDATLYVTFEPCVMCA
GAMIHSRIGRVVFGVRNAKTGAAGSLMDVLHYPGPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 242)

121 Cas9 TadACP136ins 1052
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP -continued
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLAMNHRVEITEGILADECAALLCYFFRMPRQVFNAQKKAQSSTDGSSGS
EIPGTSESATPESSGSEVEFSHEYWMRHALTLAKRARDEREVPVGAVLVL
NNRVIGEGWNRAIGLHDPTAHAEIMALRQGGLVMQNYRLIDATLYVTFEP
CVMCAGAMIHSRIGRVVFGVRNAKTGAAGSLMDVLHYPGNGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 243)

122 Cas9 TadACP136ins 1041
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNMHRVEITEG
ILADECAALLCYFFRMPRQVFNAQKKAQSSTDGSSGSETPGTSESATPES
SGSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSRI
GRVVFGVRNAKTGAAGSLMDVLHYPGNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 244)

123 Cas9 TadACP139ins 1299
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK -continued
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKYHLDEIIEQISEFSKRVILADANLDKVLSAYNKHRMN
HRVEITEGILADECAALLCYFFRMPRQVFNAQKKAQSSTDGSSGSETPGT
SESATPESSGSEVEFSHEYWMRHALTLAKRARDEREVPVGAVLVLNNRVI
GEGWNRAIGLHDPTAHAEIMALRQGGLVMQNYRLIDATLYVTFEPCVMCA
GAMIHSRIGRVVFGVRNAKTGAAGSLMDVLHYPGDKPIREQAENIIHLFT
LTNLGAPAAFKYFDTTIDRKRYTSTKEVLDATLIHQSITGLYETRIDLSQ
LGGD (SEQ ID NO: 245)

124 Cas9 delta 792-872 TadAins
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSEVEFSHE
YWMRHALTLAKRARDEREVPVGAVLVLNNRVIGEGWNRAIGLHDPTAHAE
IMALRQGGLVMQNYRLIDATLYVTFEPCVMCAGAMIHSRIGRVVFGVRNA
KTGAAGSLMDVLHYPGMNHRVEITEGILADECAALLCYFFRMPRQVFNAQ
KKAQSSTDEEVVKKMKNYWRQLLNAKLITQRKFDNLTKAERGGLSELDKA
GFIKRQLVETRQITKHVAQILDSRMNTKYDENDKLIREVKVITLKSKLVS
DFRKDFQFYKVREINNYHHAHDAYLNAVVGTALIKKYPKLESEFVYGDYK
VYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH -continued
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 246)

125 Cas9 delta 792-906 TadAins
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSEVEFSHE
YWMRHALTLAKRARDEREVPVGAVLVLNNRVIGEGWNRAIGLHDPTAHAE
IMALRQGGLVMQNYRLIDATLYVTFEPCVMCAGAMIHSRIGRVVFGVRNA
KTGAAGSLMDVLHYPGMNHRVEITEGILADECAALLCYFFRMPRQVFNAQ
KKAQSSTDGLSELDKAGFIKRQLVETRQITKHVAQILDSRMNTKYDENDK
LIREVKVITLKSKLVSDFRKDFQFYKVREINNYHHAHDAYLNAVVGTALI
KKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKT
EVQTGGFSKESILPKRNSDKLIARKKDWDPKKYGGFDSPTVAYSVLVVAK
VEKGKSKKLKSVKELLGITIMERSSFEKNPIDFLEAKGYKEVKKDLIIKL
PKYSLFELENGRKRMLASAGELQKGNELALPSKYVNFLYLASHYEKLKGS
PEDNEQKQLFVEQHKYHLDEIIEQISEFSKRVILADANLDKVLSAYNKHR
DKPIREQAENIIHLFTLTNLGAPAAFKYFDTTIDRKRYTSTKEVLDATLI
HQSITGLYETRIDLSQLGGD (SEQ ID NO: 247)

126 TadA CP65ins 1003
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI -continued
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKTAHAEIMALRQGGLVMQNYRLIDATLYVTFEPCVMCAGAMIHSRIGR
VVFGVRNAKTGAAGSLMDVLHYPGMNHRVEITEGILADECAALLCYFFRM
PRQVFNAQKKAQSSTDGSSGSETPGTSESATPESSGSEVEFSHEYWMRHA
LTLAKRARDEREVPVGAVLVLNNRVIGEGWNRAIGLHDPLESEFVYGDYK
VYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 248)

127 TadA CP65ins 1016
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV -continued
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVTAHAEIMALRQGGLVMQNYRLIDATLYVTFEPCVM
CAGAMIHSRIGVVFGVRNAKTGAAGSLMDVLHYPGMNHRVEITEGILAD
ECAALLCYFFRMPRQVFNAQKKAQSSTDGSSGSETPGTSESATPESSGSE
VEFSHEYWMRHALTLAKRARDEREVPVGAVLVLNNRVIGEGWNRAIGLHD
PYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 249)

128 TadA CP65ins 1022
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMITAHAEIMALRQGGLVMQNYRLIDATLYV
TFEPCVMCAGAMIHSRIGVVFGVRNAKTGAAGSLMDVLHYPGMNHRVEI
TEGILADECAALLCYFFRMPRQVFNAQKKAQSSTDGSSGSETPGTSESAT PESSGSEVEFSHEYWMRHALTLAKRARDEREVPVGAVLVLNNRVIGEGWN
RAIGLHDPAKSEQEIGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 250)

129 TadA CP65ins 1029
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIV+32TLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEITAHAEIMALRQGGLVMQNYRL
IDATLYVTFEPCVMCAGAMIHSRIGRVVFGVRNAKTGAAGSLMDVLHYPG
MNHRVEITEGILADECAALLCYFFRMPRQVFNAQKKAQSSTDGSSGSETP
GTSESATPESSGSEVEFSHEYWMRHALTLAKRARDEREVPVGAVLVLNNR
VIGEGWNRAIGLHDPGKATAKYFFYSNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 251)

130 TadA CP65ins 1041
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSTAHAEIMALR
QGGLVMQNYRLIDATLYVTFEPCVMCAGAMIHSRIGRVVFGVRNAKTGAA
GSLMDVLHYPGMNHRVEITEGILADECAALLCYFFRMPRQVFNAQKKAQS
STDGSSGSETPGTSESATPESSGSEVEFSHEYWMRHALTLAKRARDEREV
PVGAVLVLNNRVIGEGWNRAIGLHDPNIMNFFKTEITLANGEIRKRPLIE
TNGETGEIVWDKGRDFATVRKVLSMPQVNIVKKTEVQTGGFSKESILPKR
NSDKLIARKKDWDPKKYGGFDSPTVAYSVLVVAKVEKGKSKKLKSVKELL
GITIMERSSFEKNPIDFLEAKGYKEVKKDLIIKLPKYSLFELENGRKRML
ASAGELQKGNELALPSKYVNFLYLASHYEKLKGSPEDNEQKQLFVEQHKH
YLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQ
LGGD (SEQ ID NO: 252)

131 TadA CP65ins 1054
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP -continued
INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTDGSSGSETPGTSESATPESSGSEVEFSHEYWMRH

ALTLAKRARDEREVPVGAVLVLNNRVIGEGWNRAIGLHDPGEIRKRPLIE

TNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD (SEQ ID NO: 253)

132 TadA CP65ins 1246
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

-continued
IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGTAH

AEIMALRQGGLVMQNYRLIDATLYVTFEPCVMCAGAMIHSRIGRVVFGVR

NAKTGAAGSLMDVLHYPGMNHRVEITEGILADECAALLCYFFRMPRQVFN

AQKKAQSSTDGSSGSETPGTSESATPESSGSEVEFSHEYWMRHALTLAKR

ARDEREVPVGAVLVLNNRVIGEGWNRAIGLHDPSPEDNEQKQLFVEQHKH

YLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQ

LGGD (SEQ ID NO: 254)

In some embodiments, adenosine deaminase base editors were generated to insert TadA or variants thereof into the Cas9 polypeptide at the identified positions.

Exemplary, yet nonlimiting, fusion proteins are described in International PCT Application Nos. PCT/US2020/016285 and U.S. Provisional Application Nos. 62/852,228 and 62/852,224, the contents of which are incorporated by reference herein in their entireties.

Methods for Editing Nucleic Acids

Some aspects of the disclosure provide methods for editing a nucleic acid. In some embodiments, the method is a method for editing a nucleobase of a nucleic acid molecule encoding a protein (e.g., a base pair of a double-stranded DNA sequence). In some embodiments, the method comprises the steps of: a) contacting a target region of a nucleic acid (e.g., a double-stranded DNA sequence) with a complex comprising a base editor and a guide nucleic acid (e.g., gRNA), b) inducing strand separation of said target region, c) converting a first nucleobase of said target nucleobase pair in a single strand of the target region to a second nucleobase, and d) cutting no more than one strand of said target region using the nCas9, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., G•C to A•T). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a dCas9 domain. In some embodiments, the base editor protects or binds the non-edited strand. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein.

In some embodiments, the disclosure provides methods for editing a nucleotide (e.g., SNP in a gene encoding a protein). In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Expression of Fusion Proteins in a Host Cell

Fusion proteins of the disclosure comprising an adenosine deaminase variant may be expressed in virtually any host cell of interest, including but not limited to bacteria, yeast, fungi, insects, plants, and animal cells using routine methods known to the skilled artisan. For example, a DNA encoding an adenosine deaminase of the disclosure can be cloned by designing suitable primers for the upstream and downstream of CDS based on the cDNA sequence. The cloned DNA may be directly, or after digestion with a restriction enzyme when desired, or after addition of a suitable linker and/or a nuclear localization signal ligated with a DNA encoding one or more additional components of a base editing system. The base editing system is translated in a host cell to form a complex.

A DNA encoding a protein domain described herein can be obtained by chemically synthesizing the DNA, or by connecting synthesized partly overlapping oligoDNA short chains by utilizing the PCR method and the Gibson Assembly method to construct a DNA encoding the full length thereof. The advantage of constructing a full-length DNA by chemical synthesis or a combination of PCR method or Gibson Assembly method is that the codon to be used can be designed in CDS full-length according to the host into which the DNA is introduced. In the expression of a heterologous DNA, the protein expression level is expected to increase by converting the DNA sequence thereof to a codon highly frequently used in the host organism. As the data of codon use frequency in host to be used, for example, the genetic code use frequency database (http://www.kazusa.or.jp/codon/index.html) disclosed in the home page of Kazusa DNA Research Institute can be used, or documents showing the codon use frequency in each host may be referred to. By reference to the obtained data and the DNA sequence to be introduced, codons showing low use frequency in the host from among those used for the DNA sequence may be converted to a codon coding the same amino acid and showing high use frequency.

An expression vector containing a DNA encoding a nucleic acid sequence-recognizing module and/or a nucleic acid base converting enzyme can be produced, for example, by linking the DNA to the downstream of a promoter in a suitable expression vector.

As the expression vector, Escherichia coli-derived plasmids (e.g., pBR322, pBR325, pUC12, pUC13); Bacillus subtilis-derived plasmids (e.g., pUB110, pTP5, pC194); yeast-derived plasmids (e.g., pSH19, pSH15); insect cell expression plasmids (e.g., pFast-Bac); animal cell expression plasmids (e.g., pA1-11, pXT1, pRc/CMV, pRc/RSV, pcDNAI/Neo); bacteriophages such as .lamda.phage and the like; insect virus vectors such as baculovirus and the like (e.g., BmNPV, AcNPV); animal virus vectors such as retrovirus, vaccinia virus, adenovirus and the like, and the like are used.

As the promoter, any promoter appropriate for a host to be used for gene expression can be used. In a conventional method using DSB, since the survival rate of the host cell sometimes decreases markedly due to the toxicity, it is desirable to increase the number of cells by the start of the induction by using an inductive promoter. However, since sufficient cell proliferation can also be afforded by expressing the nucleic acid-modifying enzyme complex of the present disclosure, a constitution promoter can also be used without limitation.

For example, when the host is an animal cell, SR.alpha. promoter, SV40 promoter, LTR promoter, CMV (cytomegalovirus) promoter, RSV (Rous sarcoma virus) promoter, MoMuLV (Moloney mouse leukemia virus) LTR, HSV-TK (simple herpes virus thymidine kinase) promoter and the like are used. Of these, CMV promoter, SR.alpha. promoter and the like are preferable.

When the host is Escherichia coli, trp promoter, lac promoter, recA promoter, lamda.P.sub.L promoter, lpp promoter, T7 promoter and the like are preferable.

When the host is genus Bacillus, SPO1 promoter, SPO2 promoter, penP promoter and the like are preferable.

When the host is a yeast, Gal1/10 promoter, PHO5 promoter, PGK promoter, GAP promoter, ADH promoter and the like are preferable.

When the host is an insect cell, polyhedrin promoter, P10 promoter and the like are preferable.

When the host is a plant cell, CaMV35S promoter, CaMV19S promoter, NOS promoter and the like are preferable.

As the expression vector, besides those mentioned above, one containing enhancer, splicing signal, terminator, polyA addition signal, a selection marker such as drug resistance gene, auxotrophic complementary gene and the like, replication origin and the like on demand can be used.

An RNA encoding a protein domain described herein can be prepared by, for example, transcription to mRNA in a vitro transcription system known per se by using a vector encoding DNA encoding the above-mentioned nucleic acid sequence-recognizing module and/or a nucleic acid base converting enzyme as a template.

A fusion protein of the disclosure can be intracellularly expressed by introducing an expression vector containing a DNA encoding a nucleic acid sequence-recognizing module and/or a nucleic acid base converting enzyme into a host cell and culturing the host cell.

As the host, genus Escherichia, genus Bacillus, yeast, insect cell, insect, animal cell and the like are used.

As the genus Escherichia, Escherichia coli K12.cndot.DH1 [Proc. Natl. Acad. Sci. USA, 60, 160 (1968)], Escherichia coli JM103 [Nucleic Acids Research, 9, 309 (1981)], Escherichia coli JA221 [Journal of Molecular Biology, 120, 517 (1978)], Escherichia coli HB101 [Journal of Molecular Biology, 41, 459 (1969)], Escherichia coli C600 [Genetics, 39, 440 (1954)] and the like are used.

As the genus Bacillus, Bacillus subtilis M1114 [Gene, 24, 255 (1983)], Bacillus subtilis 207-21 [Journal of Biochemistry, 95, 87 (1984)] and the like are used.

As the yeast, Saccharomyces cerevisiae AH22, AH22R.sup.-, NA87-11A, DKD-5D, 20B-12, Schizosaccharomyces pombe NCYC1913, NCYC2036, Pichia pastoris KM71 and the like are used.

As the insect cell when the virus is AcNPV, cells of cabbage armyworm larva-derived established line (Spodoptera frugiperda cell; Sf cell), MG1 cells derived from the mid-intestine of Trichoplusia ni, High Five™ cells derived from an egg of Trichoplusia ni, Mamestra brassicae-derived cells, Estigmena acrea-derived cells and the like are used. When the virus is BmNPV, cells of Bombyx mori-derived established line (Bombyx mori N cell; BmN cell) and the like are used as insect cells. As the Sf cell, for example, Sf9 cell (ATCC CRL1711), Sf21 cell [all above, In Vivo, 13, 213-217 (1977)] and the like are used.

As the insect, for example, larva of Bombyx mori, Drosophila, cricket and the like are used [Nature, 315, 592 (1985)].

As the animal cell, cell lines such as monkey COS-7 cell, monkey Vero cell, Chinese hamster ovary (CHO) cell, dhfr gene-deficient CHO cell, mouse L cell, mouse AtT-20 cell, mouse myeloma cell, rat GH3 cell, human FL cell and the like, pluripotent stem cells such as iPS cell, ES cell and the like of human and other mammals, and primary cultured cells prepared from various tissues are used. Furthermore, zebrafish embryo, Xenopus oocyte and the like can also be used.

As the plant cell, suspend cultured cells, callus, protoplast, leaf segment, root segment and the like prepared from various plants (e.g., grain such as rice, wheat, corn and the like, product crops such as tomato, cucumber, eggplant and the like, garden plants such as carnation, Eustoma russellianum and the like, experiment plants such as tobacco, Arabidopsis thaliana and the like, and the like) are used.

All the above-mentioned host cells may be haploid (monoploid), or polyploid (e.g., diploid, triploid, tetraploid and the like). In the conventional mutation introduction methods, mutation is, in principle, introduced into only one homologous chromosome to produce a hetero gene type. Therefore, desired phenotype is not expressed unless dominant mutation occurs, and homozygousness inconveniently requires labor and time. In contrast, according to the present disclosure, since mutation can be introduced into any allele on the homologous chromosome in the genome, desired phenotype can be expressed in a single generation even in the case of recessive mutation, which is extremely useful since the problem of the conventional method can be solved.

An expression vector can be introduced by a known method (e.g., lysozyme method, competent method, PEG method, $CaCl_2$) coprecipitation method, electroporation method, the microinjection method, the particle gun method, lipofection method, *Agrobacterium* method and the like) according to the kind of the host.

*Escherichia coli* can be transformed according to the methods described in, for example, Proc. Natl. Acad. Sci. USA, 69, 2110 (1972), Gene, 17, 107 (1982) and the like.

The genus *Bacillus* can be introduced into a vector according to the methods described in, for example, Molecular & General Genetics, 168, 111 (1979) and the like.

A yeast can be introduced into a vector according to the methods described in, for example, Methods in Enzymology, 194, 182-187 (1991), Proc. Natl. Acad. Sci. USA, 75, 1929 (1978) and the like.

An insect cell and an insect can be introduced into a vector according to the methods described in, for example, Bio/Technology, 6, 47-55 (1988) and the like.

An animal cell can be introduced into a vector according to the methods described in, for example, Cell Engineering additional volume 8, New Cell Engineering Experiment Protocol, 263-267 (1995) (published by Shujunsha), and Virology, 52, 456 (1973).

A cell introduced with a vector can be cultured according to a known method according to the kind of the host.

For example, when *Escherichia coli* or genus *Bacillus* is cultured, a liquid medium is preferable as a medium to be used for the culture. The medium preferably contains a carbon source, nitrogen source, inorganic substance and the like necessary for the growth of the transformant. Examples of the carbon source include glucose, dextrin, soluble starch, sucrose and the like; examples of the nitrogen source include inorganic or organic substances such as ammonium salts, nitrate salts, corn steep liquor, peptone, casein, meat extract, soybean cake, potato extract and the like; and examples of the inorganic substance include calcium chloride, sodium dihydrogen phosphate, magnesium chloride and the like. The medium may contain yeast extract, vitamins, growth promoting factor and the like. The pH of the medium is preferably about 5-about 8.

As a medium for culturing *Escherichia coli*, for example, M9 medium containing glucose, casamino acid [Journal of Experiments in Molecular Genetics, 431-433, Cold Spring Harbor Laboratory, New York 1972] is preferable. Where necessary, for example, agents such as 3.beta.-indolylacrylic acid may be added to the medium to ensure an efficient function of a promoter. *Escherichia coli* is cultured at generally about 15-about 43° C. Where necessary, aeration and stirring may be performed.

The genus *Bacillus* is cultured at generally about 30-about 40° C. Where necessary, aeration and stirring may be performed.

Examples of the medium for culturing yeast include Burkholder minimum medium [Proc. Natl. Acad. Sci. USA, 77, 4505 (1980)], SD medium containing 0.5% casamino acid [Proc. Natl. Acad. Sci. USA, 81, 5330 (1984)] and the like. The pH of the medium is preferably about 5-about 8. The culture is performed at generally about 20° C.-about 35° C. Where necessary, aeration and stirring may be performed.

As a medium for culturing an insect cell or insect, for example, Grace's Insect Medium [Nature, 195, 788 (1962)] containing an additive such as inactivated 10% bovine serum and the like as appropriate and the like are used. The pH of the medium is preferably about 6.2 to about 6.4. The culture is performed at generally about 27° C. Where necessary, aeration and stirring may be performed.

As a medium for culturing an animal cell, for example, minimum essential medium (MEM) containing about 5-about 20% of fetal bovine serum [Science, 122, 501 (1952)], Dulbecco's modified Eagle medium (DMEM) [Virology, 8, 396 (1959)], RPMI 1640 medium [The Journal of the American Medical Association, 199, 519 (1967)], 199 medium [Proceeding of the Society for the Biological Medicine, 73, 1 (1950)] and the like are used. The pH of the medium is preferably about 6-about 8. The culture is performed at generally about 30° C.-about 40° C. Where necessary, aeration and stirring may be performed.

As a medium for culturing a plant cell, for example, MS medium, LS medium, B5 medium and the like are used. The pH of the medium is preferably about 5-about 8. The culture is performed at generally about 20° C.-about 30° C. Where necessary, aeration and stirring may be performed.

When a higher eukaryotic cell, such as animal cell, insect cell, plant cell and the like is used as a host cell, a DNA encoding a base editing system of the present disclosure (e.g., comprising an adenosine deaminase variant) is introduced into a host cell under the regulation of an inducible promoter (e.g., metallothionein promoter (induced by heavy metal ion), heat shock protein promoter (induced by heat shock), Tet-ON/Tet-OFF system promoter (induced by addition or removal of tetracycline or a derivative thereof), steroid-responsive promoter (induced by steroid hormone or a derivative thereof) etc.), the induction substance is added to the medium (or removed from the medium) at an appropriate stage to induce expression of the nucleic acid-modifying enzyme complex, culture is performed for a given period to carry out a base editing and, introduction of a mutation into a target gene, transient expression of the base editing system can be realized.

Prokaryotic cells such as *Escherichia coli* and the like can utilize an inducible promoter. Examples of the inducible promoter include, but are not limited to, lac promoter (induced by IPTG), cspA promoter (induced by cold shock), araBAD promoter (induced by arabinose) and the like.

Alternatively, the above-mentioned inductive promoter can also be utilized as a vector removal mechanism when higher eukaryotic cells, such as animal cell, insect cell, plant cell and the like are used as a host cell. That is, a vector is mounted with a replication origin that functions in a host cell, and a nucleic acid encoding a protein necessary for replication (e.g., SV40 on and large T antigen, oriP and EBNA-1 etc. for animal cells), of the expression of the nucleic acid encoding the protein is regulated by the above-mentioned inducible promoter. As a result, while the vector is autonomously replicatable in the presence of an induction substance, when the induction substance is removed, autonomous replication is not available, and the vector naturally falls off along with cell division (autonomous replication is not possible by the addition of tetracycline and doxycycline in Tet-OFF system vector).

Delivery System

Nucleic Acid-Based Delivery of a Nucleobase Editors and gRNAs

Nucleic acids encoding base editing systems according to the present disclosure can be administered to subjects or delivered into cells in vitro or in vivo by art-known methods or as described herein. In one embodiment, nucleobase editors can be delivered by, e.g., vectors (e.g., viral or non-viral vectors), non-vector based methods (e.g., using naked DNA, DNA complexes, lipid nanoparticles), or a combination thereof.

Nucleic acids encoding nucleobase editors can be delivered directly to cells (e.g., hematopoietic cells or their progenitors, hematopoietic stem cells, and/or induced pluripotent stem cells) as naked DNA or RNA, for instance by means of transfection or electroporation, or can be conjugated to molecules (e.g., N-acetylgalactosamine) promoting uptake by the target cells. Nucleic acid vectors, such as the vectors described herein can also be used.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and an adenosine deaminase variant (e.g., ABE8).

The nucleic acid vector can also include any suitable number of regulatory/control elements, e.g., promoters, enhancers, introns, polyadenylation signals, Kozak consensus sequences, or internal ribosome entry sites (IRES). These elements are well known in the art. For hematopoietic cells suitable promoters can include IFNbeta or CD45.

Nucleic acid vectors according to this disclosure include recombinant viral vectors. Exemplary viral vectors are set forth herein. Other viral vectors known in the art can also be used. In addition, viral particles can be used to deliver base editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 11 (below).

TABLE 11

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyltrimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 12 lists exemplary polymers for use in gene transfer and/or nanoparticle formulations.

TABLE 12

Polymers Used for Gene Transfer

| Polymer | Abbreviation |
| --- | --- |
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |

TABLE 12-continued

Polymers Used for Gene Transfer

| Polymer | Abbreviation |
| --- | --- |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated Histone Collagen | chitosan |
| Dextran-spermine | D-SPM |

Table 13 summarizes delivery methods for a polynucleotide encoding a fusion protein described herein.

TABLE 13

| Delivery | Vector/Mode | Delivery into Non-Dividing Cells | Duration of Expression | Genome Integration | Type of Molecule Delivered |
| --- | --- | --- | --- | --- | --- |
| Physical | (e.g., electroporation, particle gun, Calcium Phosphate transfection | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in a complex with the targeting gRNA. RNPs may be delivered to cells using known methods, such as electroporation, nucleofection, or cationic lipid-mediated methods, for example, as reported by Zuris, J. A. et al., 2015, *Nat. Biotechnology*, 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR).

A promoter used to drive base editor coding nucleic acid molecule expression can include AAV ITR. This can be advantageous for eliminating the need for an additional promoter element, which can take up space in the vector. The additional space freed up can be used to drive the expression of additional elements, such as a guide nucleic acid or a selectable marker. ITR activity is relatively weak, so it can be used to reduce potential toxicity due to over expression of the chosen nuclease.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: SynapsinI for all neurons, CaMKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For Osteoblasts suitable promoters can include OG-2.

In some embodiments, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

Viral Vectors

A base editor described herein can therefore be delivered with viral vectors. In some embodiments, a base editor disclosed herein can be encoded on a nucleic acid that is contained in a viral vector. In some embodiments, one or more components of the base editor system can be encoded on one or more viral vectors. For example, a base editor and guide nucleic acid can be encoded on a single viral vector. In other embodiments, the base editor and guide nucleic acid are encoded on different viral vectors. In either case, the base editor and guide nucleic acid can each be operably linked to a promoter and terminator. The combination of components encoded on a viral vector can be determined by the cargo size constraints of the chosen viral vector.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Viral vectors can include lentivirus (e.g., HIV and FIV-based vectors), Adenovirus (e.g., AD100), Retrovirus (e.g., Maloney murine leukemia virus, MML-V), herpesvirus vectors (e.g., HSV-2), and Adeno-associated viruses (AAVs), or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (See, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some aspects, a base editor of the present disclosure is of sufficient size so as to enable efficient packaging and delivery into a target cell via a retroviral vector. In some embodiments, a base editor is of a size so as to allow efficient packing and delivery even when expressed together with a guide nucleic acid and/or other components of a targetable nuclease system.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors can also be used to transduce cells with target nucleic acids, e.g., in the in vitro production of nucleic acids and peptides, and for in vivo and ex vivo gene therapy procedures (See, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the disclosure and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

Viral vectors can be selected based on the application. For example, for in vivo gene delivery, AAV can be advantageous over other viral vectors. In some embodiments, AAV allows low toxicity, which can be due to the purification method not requiring ultra-centrifugation of cell particles that can activate the immune response. In some embodiments, AAV allows low probability of causing insertional mutagenesis because it doesn't integrate into the host genome. Adenoviruses are commonly used as vaccines because of the strong immunogenic response they induce. Packaging capacity of the viral vectors can limit the size of the base editor that can be packaged into the vector.

AAV has a packaging capacity of about 4.5 Kb or 4.75 Kb including two 145 base inverted terminal repeats (ITRs). This means disclosed base editor as well as a promoter and transcription terminator can fit into a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some embodiments, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82: 5887-5911 (2008)).

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media is changed to OptiMEM (serum-free) media and transfection was done 4 hours later. Cells are transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection can be done in 4 mL OptiMEM with a cationic lipid delivery agent (50 μl Lipofectamine 2000 and 100 ul Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 μm low protein binding (PVDF) filter. They are then spun in an ultracentrifuge for 2 hours at 24,000 rpm. Viral pellets are resuspended in 50 μl of DMEM overnight at 4° C. They are then aliquoted and immediately frozen at −80° C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self-inactivating lentiviral vectors are contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GC-CACC), nuclease sequence, and 3' UTR such as a 3' UTR from beta globin-polyA tail. The cassette can be used for transcription by T7 polymerase. Guide polynucleotides (e.g., gRNA) can also be transcribed using in vitro transcription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the disclosure can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Inteins

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

Inteins (intervening protein) are auto-processing domains found in a variety of diverse organisms, which carry out a process known as protein splicing. Protein splicing is a multi-step biochemical reaction comprised of both the cleavage and formation of peptide bonds. While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are transcribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio)esterification by nucleophilic attack of the first C-extein residue (+1), which is a cysteine, serine, or threonine. The resulting branched (thio)ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

In some embodiments, an N-terminal fragment of a base editor (e.g., ABE, CBE) is fused to a split intein-N and a C-terminal fragment is fused to a split intein-C. These fragments are then packaged into two or more AAV vectors. The use of certain inteins for joining heterologous protein fragments is described, for example, in Wood et al., J. Biol.

Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

In some embodiments, an ABE was split into N- and C-terminal fragments at Ala, Ser, Thr, or Cys residues within selected regions of SpCas9. These regions correspond to loop regions identified by Cas9 crystal structure analysis. The N-terminus of each fragment is fused to an intein-N and the C-terminus of each fragment is fused to an intein C at amino acid positions S303, T310, T313, S355, A456, S460, A463, T466, S469, T472, T474, C574, S577, A589, and S590, which are indicated in Bold Capitals in the sequence below.

293T, K562 or U20S. Alternatively, primary cells (e.g., human) may be used. Such cells may be relevant to the eventual cell target.

Delivery may be performed using a viral vector. In one embodiment, transfection may be performed using lipid transfection (such as Lipofectamine or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed

```
   1    mdkkysigld  igtnsvgwav  itdeykvpsk  kfkvlgntdr  hsikknliga  llfdsgetae
  61    atrlkrtarr  rytrrknric  ylqeifsnem  akvddsffhr  leesflveed  kkherhpifg
 121    nivdevayhe  kyptiyhlrk  klvdstdkad  lrliylalah  mikfrghfli  egdlnpdnsd
 181    vdklfiqlvq  tynqlfeenp  inasgvdaka  ilsarlsksr  rlenliaqlp  gekknglfgn
 241    lialslgltp  nfksnfdlae  daklqlskdt  ydddldnlla  gigdqyadlf  laaknlsdai
 301    llSdilrvnT  eiTkaplsas  mikrydehhq  dltllkalvr  qqlpekykei  ffdqSkngya
 361    gyidggasqe  efykfikpil  ekmdgteell  vklnredllr  kqrtfdngsi  phqihlgelh
 421    ailrrqedfy  pflkdnreki  ekiltfripy  yvgplArgnS  rfAwmTrkSe  eTiTpwnfee
 481    vvdkgasaqs  fiermtnfdk  nlpnekvlpk  hsllyeyftv  yneltkvkyv  tegmrkpafl
 541    sgeqkkaivd  llfktnrkvt  vkqlkedyfk  kieCfdSvei  sgvedrfnAS  lgtyhdllki
 601    ikdkdfldne  enedilediv  ltltlfedre  mieerlktya  hlfddkvmkq  lkrrrytgwg
 661    rlsrklingi  rdkqsgktil  dflksdgfan  rnfmqlihdd  sltfkediqk  aqvsgqgdsl
 721    hehianlags  paikkgilqt  vkvvdelvkv  mgrhkpeniv  iemarenqtt  qkgqknsrer
 781    mkrieegike  lgsqilkehp  ventqlqnek  lylyylqngr  dmyvdgeldi  nrlsdydvdh
 841    ivpqsflkdd  sidnkvltrs  dknrgksdnv  pseevvkkmk  nywrqllnak  litqrkfdnl
 901    tkaergglse  ldkagfikrq  lvetrqitkh  vaqildsrmn  tkydendkli  revkvitlks
 961    klvsdfrkdf  qfykvreinn  yhhandayln  avvgtalikk  ypklesefvy  gdykvydvrk
1021    miakseqeig  katakyffys  nimnffktei  tlangeirkr  plietngetg  eivwdkgrdf
1081    atvrkvlsmp  qvnivkktev  qtggfskesi  lpkrnsdkli  arkkdwdpkk  yggfdsptva
1141    ysvlvvakve  kgkskklksv  kellgitime  rssfeknpid  fleakgykev  kkdliiklpk
1201    yslfelengr  krmlasagel  qkgnelalps  kyvnflylas  hyeklkgspe  dneqkqlfve
1261    qhkhyldeii  eqisefskrv  iladanldkv  lsaynkhrdk  pireqaenii  hlftltnlga
1321    paafkyfdtt  idrkrytstk  evldatlihq  sitglyetri  dlsqlggd
        (SEQ ID NO: 1)
```

Use of Nucleobase Editors to Target Mutations

The suitability of nucleobase editors that targets a mutation is evaluated as described herein. In one embodiment, a single cell of interest is transduced with a base editing system together with a small amount of a vector encoding a reporter (e.g., GFP). These cells can be any cell line known in the art, including immortalized human cell lines, such as using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq).

The fusion proteins that induce the greatest levels of target specific alterations in initial tests can be selected for further evaluation.

In particular embodiments, the nucleobase editors are used to target polynucleotides of interest. In one embodiment, a nucleobase editor of the disclosure is delivered to cells (e.g., hematopoietic cells or their progenitors, hematopoietic stem cells, and/or induced pluripotent stem cells) in conjunction with a guide RNA that is used to target a mutation of interest within the genome of a cell, thereby altering the mutation. In some embodiments, a base editor is targeted by a guide RNA to introduce one or more edits to the sequence of a gene of interest.

The system can comprise one or more different vectors. In an aspect, the base editor is codon optimized for expression the desired cell type, preferentially a eukaryotic cell, preferably a mammalian cell or a human cell.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/(visited Jul. 9, 2002), and these tables can be adapted in a number of ways. See, Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid is in some cases is not packaged in significant amounts due to a lack of ITR sequences. Contamination with adenovirus can be reduced by, e.g., heat treatment to which adenovirus is more sensitive than AAV.

Applications for Multi-Effector Nucleobase Editors

The multi-effector nucleobase editors can be used to target polynucleotides of interest to create alterations that modify protein expression. In one embodiment, a multi-effector nucleobase editor is used to modify a non-coding or regulatory sequence, including but not limited to splice sites, enhancers, and transcriptional regulatory elements. The effect of the alteration on the expression of a gene controlled by the regulatory element is then assayed using any method known in the art. In a particular embodiment, a multi-effector nucleobase editor is able to substantially alter a regulatory sequence, thereby abolishing its ability to regulate gene expression. Advantageously, this can be done without generating double-stranded breaks in the genomic target sequence, in contrast to other RNA-programmable nucleases.

The multi-effector nucleobase editors can be used to target polynucleotides of interest to create alterations that modify protein activity. In the context of mutagenesis, for example, multi-effector nucleobase editors have a number of advantages over error-prone PCR and other polymerase-based methods. Because multi-effector nucleobase editors of the disclosure create alterations at multiple bases in a target region, such mutations are more likely to be expressed at the protein level relative to mutations introduced by error-prone PCR, which are less likely to be expressed at the protein level given that a single nucleotide change in a codon may still encode the same amino acid (e.g., codon degeneracy). Unlike error-prone PCR, which induces random alterations throughout a polynucleotide, multi-effector nucleobase editors of the disclosure can be used to target specific amino acids within a small or defined region of a protein of interest.

In other embodiments, a multi-effector nucleobase editor of the disclosure is used to target a polynucleotide of interest within the genome of an organism. In one embodiment, the organism is a bacteria of the microbiome (e.g., Bacteriodetes, Verrucomicrobia, Firmicutes; Gammaproteobacteria, Alphaproteobacteria, Bacteriodetes, Clostridia, Erysipelotrichia, Bacilli; Enterobacteriales, Bacteroidales, Verrucomicrobiales, Clostridiales, Erysipelotrichales, Lactobacillales; Enterobacteriaceae, Bacteroidaceae, Erysiopelotrichaceae, Prevotellaceae, Coriobacteriaceae, and Alcaligenaceae, *Escherichia, Bacteroides, Alistipes, Akkermansia, Clostridium, Lactobacillus*). In another embodiment, the organism is an agriculturally important animal (e.g., cow, sheep, goat, horse, chicken, turkey) or plant (e.g., soybeans, wheat, corn, rice, tobacco, apples, grapes, peaches, plums, cherries). In one embodiment, a multi-effector nucleobase editor of the disclosure is delivered to cells in conjunction with a library of guide RNAs that are used to tile a variety of sequences within the genome of a cell, thereby systematically altering sequences throughout the genome.

Mutations may be made in any of a variety of proteins to facilitate structure function analysis or to alter the endogenous activity of the protein. Mutations may be made, for example, in an enzyme (e.g., kinase, phosphatase, carboxylase, phosphodiesterase) or in an enzyme substrate, in a receptor or in its ligand, and in an antibody and its antigen. In one embodiment, a multi-effector nucleobase editor targets a nucleic acid molecule encoding the active site of the enzyme, the ligand binding site of a receptor, or a complementarity determining region (CDR) of an antibody. In the case of an enzyme, inducing mutations in the active site could increase, decrease, or abolish the enzyme's activity. The effect of mutations on the enzyme is characterized in an enzyme activity assay, including any of a number of assays known in the art and/or that would be apparent to the skilled artisan. In the case of a receptor, mutations made at the ligand binding site could increase, decrease or abolish the receptors affinity for its ligand. The effect of such mutations is assayed in a receptor/ligand binding assay, including any of a number of assays known in the art and/or that would be apparent to the skilled artisan.

Synthetic Library

Provided herein are fusion protein libraries and method for using same to optimize base editing that allow for alternative preferred base editing windows compared to canonical base editors. In some embodiments, the disclosure provides a protein library for optimized base editing comprising a plurality of fusion proteins, wherein each one of the plurality of fusion proteins comprises a deaminase flanked by a N-terminal fragment and a C-terminal fragment of a Cas9 polypeptide, wherein the N-terminal fragment of each one of the fusion proteins differs from the N-terminal fragments of the rest of the plurality of fusion proteins or wherein the C-terminal fragment of each one of the fusion proteins differs from the C-terminal fragments of the rest of the plurality of fusion proteins, wherein the deaminase of each one of the fusion proteins deaminates a target nucleobase in proximity to a Protospacer Adjacent Motif (PAM) sequence in a target polynucleotide sequence, and wherein the N terminal fragment or the C terminal fragment binds the target polynucleotide sequence. In some embodiments, for each nucleobase within a CRISPR R-loop, at least one of the plurality of fusion proteins deaminates the nucleobase. In some embodiments, for each nucleobase within of a target polynucleotide from 1 to 20 base pairs away of a PAM sequence, at least one of the plurality of fusion proteins deaminates the nucleobase. In some embodiments, provided herein is a kit comprising the fusion protein library that allows for optimized base editing.

In some embodiments, a synthetic library of adenosine deaminases alleles, e.g., TadA alleles can be utilized to generate an adenosine base editor with modified base editing efficiency and/or specificity. In some embodiments, an adenosine base editor generated from a synthetic library comprises higher base editing efficiency and/or specificity. In some embodiments, an adenosine base editor generated from a synthetic library exhibits increased base editing efficiency, increased base editing specificity, reduced off-target editing, reduced bystander editing, reduced indel formation, and/or reduced spurious editing compared to an adenosine base editor with a wild type TadA. In some embodiments, an adenosine base editor generated from a synthetic library exhibits increased base editing efficiency, increased base editing specificity, reduced off-target editing, reduced bystander editing, reduced indel formation, and/or reduced spurious editing compared to an adenosine base editor with a TadA*7.10. In some embodiments, the synthetic library comprises randomized TadA portion of ABE. In some embodiments, the synthetic library comprises all 20 canonical amino acid substitutions at each position of TadA. In some embodiments, the synthetic library comprises an average frequency of 1-2 nucleotide substitution mutations per library member. In some embodiments, the synthetic library comprises background mutations found in TadA*7.10.

Pharmaceutical Compositions

Other aspects of the present disclosure relate to pharmaceutical compositions comprising any of the base editors, fusion proteins, or the fusion protein-guide polynucleotide complexes described herein. The term "pharmaceutical composition," as used herein, refers to a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient," "carrier," "pharmaceutically acceptable carrier," "vehicle" or the like are used interchangeably herein.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseous, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249: 1527-1533; Sefton, 1989, CRC Crit. Ref. Biomed. Eng. 14:201; Buchwald et al., 1980, Surgery 88:507; Saudek et al, 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228: 190; During et al., 1989, Ann. Neurol. 25:351; Howard et ah, 1989, J. Neurosurg. 71: 105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid and stabilized by a polyethyleneglycol (PEG) coating (Zhang Y. P. et ah, Gene Ther. 1999, 6: 1438-47). Positively charged lipids such as N-[1-(2,3-dioleoyloxi)propyl]-N,N,N-trimethyl-amoniummethylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the disclosure in lyophilized form and (b) a second container containing a pharmaceutically acceptable diluent (e.g., sterile used for reconstitution or dilution of the lyophilized compound of the disclosure. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the disclosure. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, Md., 2006; incorporated in its entirety herein by reference) discloses various excipients used in formulating pharmaceutical compositions and known techniques for the preparation thereof. See also PCT application PCT/US2010/055131 (Publication number WO2011/053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

In some embodiments, compositions in accordance with the present disclosure can be used for treatment of any of a variety of diseases, disorders, and/or conditions.

Kits

Various aspects of this disclosure provide kits comprising a base editor system. In one embodiment, the kit comprises a nucleic acid construct comprising a nucleotide sequence encoding a nucleobase editor fusion protein. The fusion protein comprises a deaminase (e.g., adenine deaminase) and a nucleic acid programmable DNA binding protein (napDNAbp). In some embodiments, the kit comprises at least one guide RNA capable of targeting a nucleic acid molecule of interest. In some embodiments, the kit comprises a nucleic acid construct comprising a nucleotide sequence encoding at least one guide RNA.

The kit provides, in some embodiments, instructions for using the kit to edit one or more mutations. The instructions will generally include information about the use of the kit for editing nucleic acid molecules. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

The practice of the present disclosure employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the disclosure, and, as such, may be considered in making and practicing the disclosure. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Adenosine Base Editors with Increased Editing Efficiency

Figure 2B:
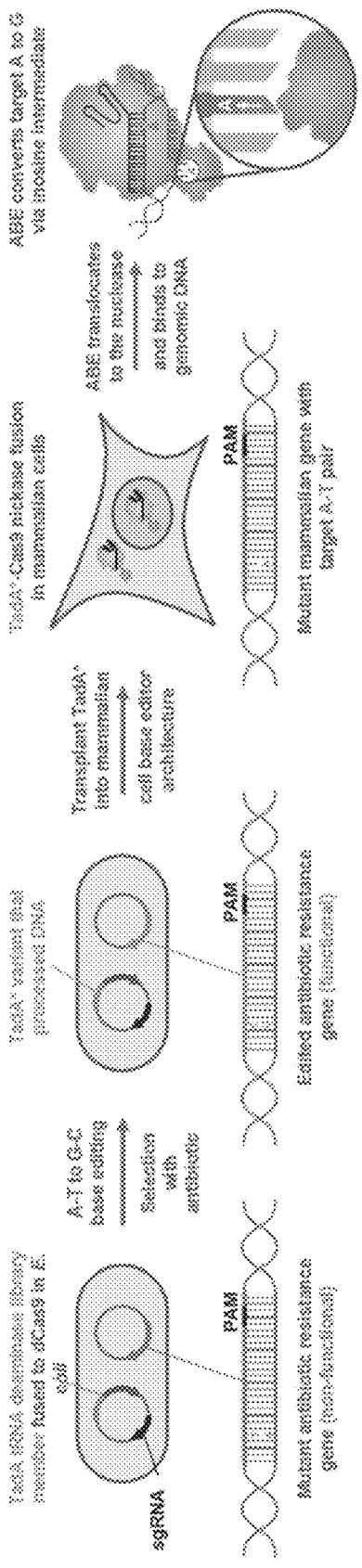

Base editing systems that include a Tad7.10-dCas9 fusion proteins are capable of editing a target polynucleotide with approximately 10-20% efficiency, but for uses requiring higher efficiency their use may be limited. In an effort to identify adenine base editors having increased efficiency and specificity, constructs comprising the adenosine deaminase TadA 7.10 were mutagenized by error prone PCR and subsequently cloned into an expression vector adjacent to a nucleic acid sequence encoding dCas9, a nucleic acid programmable DNA binding protein (FIG. 1A, FIG. 2B). The expression vectors comprising the adenosine deaminase variants were co-transformed into competent bacterial cells with a selection plasmid encoding chloramphenicol resistance (CamR) and spectinomycin resistance (SpectR) and having a kanamycin resistance gene that was rendered nonfunctional by two point mutations (evolution round 7 strategy) (FIG. 1B, FIG. 2B). The cells were selected for restoration of kanamycin resistance, which was a read out for adenosine deaminase activity. In subsequent rounds of selection, the expression vectors were co-transformed into competent cells with a plasmid encoding chloramphenicol resistance (CamR) and spectinomycin resistance (SpectR) and having a kanamycin resistance gene that was rendered nonfunctional by three point mutations (evolution round 8 strategy) (FIG. 1C, FIG. 2B). An inactivated kanamycin resistance gene nucleic acid sequence is provided below:

ccggaattgccagctggggcgccctctggtaaggttgggaagccctgcaa agtaaactggatggctttcttgccgccaaggatctgatggcgcaggggat caagatctgatcaagagacaggatgaggat<u>cct</u>ttcgcATGATCGAATAA

GATGGATTGCACGCAGGTTCTCCGCCGCTTAGGTGGAGCGCCTATT<u>CGG</u>

CTATGACTGGGCACAACAGACAATCGGCTGCTCTGATGCCGCCGTGTTCC

-continued
GGCTGTCAGCGCAGGGGCGCCCGGTTCTTTTTGTCAAGACCGACCTGTCC

GGTGCCCTGAATGAACTGCAGGACGAGGCAGCGCGGCTATCGTGGCTGGC

CACGACGGGCGTTCCTTGCGCAGCTGTGCTCGACGTTGTCACTGAAGCGG

GAAGGGACTGGCTGCTATTGGGCGAAGTGCCGGGGCAGGATCTCCTGTCA

TCTCACCTTGCTCCTGCCGAGAAAGTATCCATCATGGCTGATGCAATGCG

GCGGCTGCATACGCTTGATCCGGCTACCTGCCCATTCGACCACCAAGCGA

AACATCGCATCGAGCGAGCACGTACTCGGATGGAAGCCGGTCTTGTCGAT

CAGGATGATCTGGACGAAGAGCATCAGGGGCTCGCGCCAGCCGAACTGTT

CGCCAGGCTCAAGGCGCGCATGCCCGACGGCGAGGATCTCGTCGTGACCC

ATGGCGATGCCTGCTTGCCGAATATCATGGTGGAAAATGGCCGCTTTTCT

GGA*TTCATTAACTGTGGCCGGCT*<u>GGG</u>TGTGGCGGACCGCTATCAGGACAT

AGCGTTGGCTACCCGTGATATTGCTGAAGAGCTTGGCGGCGAATGGGCTG

ACCGCTTCCTCGTGCTTTACGGTATCGCCGCTCCCGATTCGCAGCGCATC

GCCTTCTATCGCCTTCTTGACGAGTTCTTCTAA (SEQ ID NO: 255)

In the above sequence, lower case denotes the kanamycin resistance promoter region, bold sequence indicates targeted inactivation portion (Q4* and W15*), the italicized sequence denotes the targeted inactive site of kanamycin resistance gene (D208N), and the underlined sequences denote the PAM sequences.

Figure 2C:
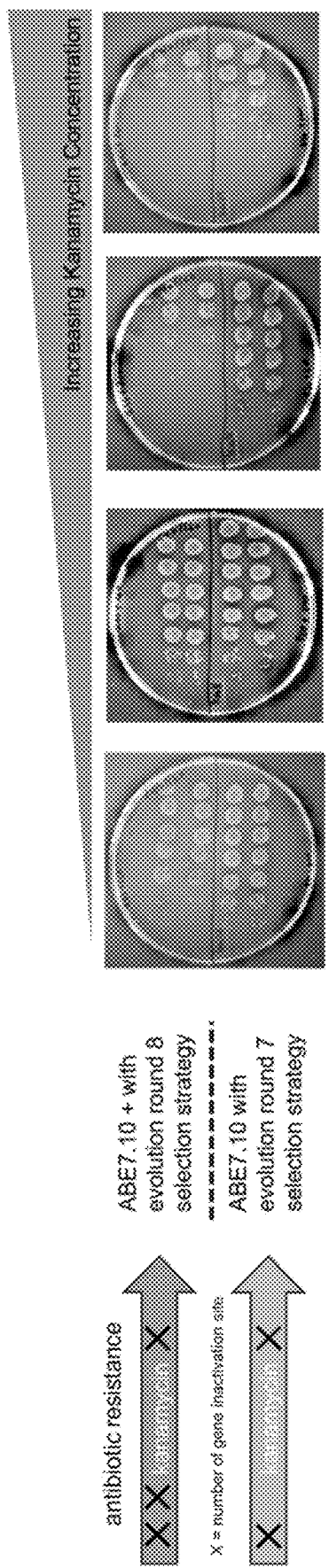

Again, the cells were plated onto a series of agarose plates with increasing kanamycin concentration. As shown in FIG. 2C, adenosine deaminase variants having efficient base editing activity were able to correct the mutations present in the kanamycin resistance gene and were selected for further analysis. Adenosine deaminase variant base editors showing efficient base editing in bacterial cells are described in Table 14. Mammalian expression vectors encoding base editors comprising the selected adenosine deaminase variants were generated.

Figure 3A:
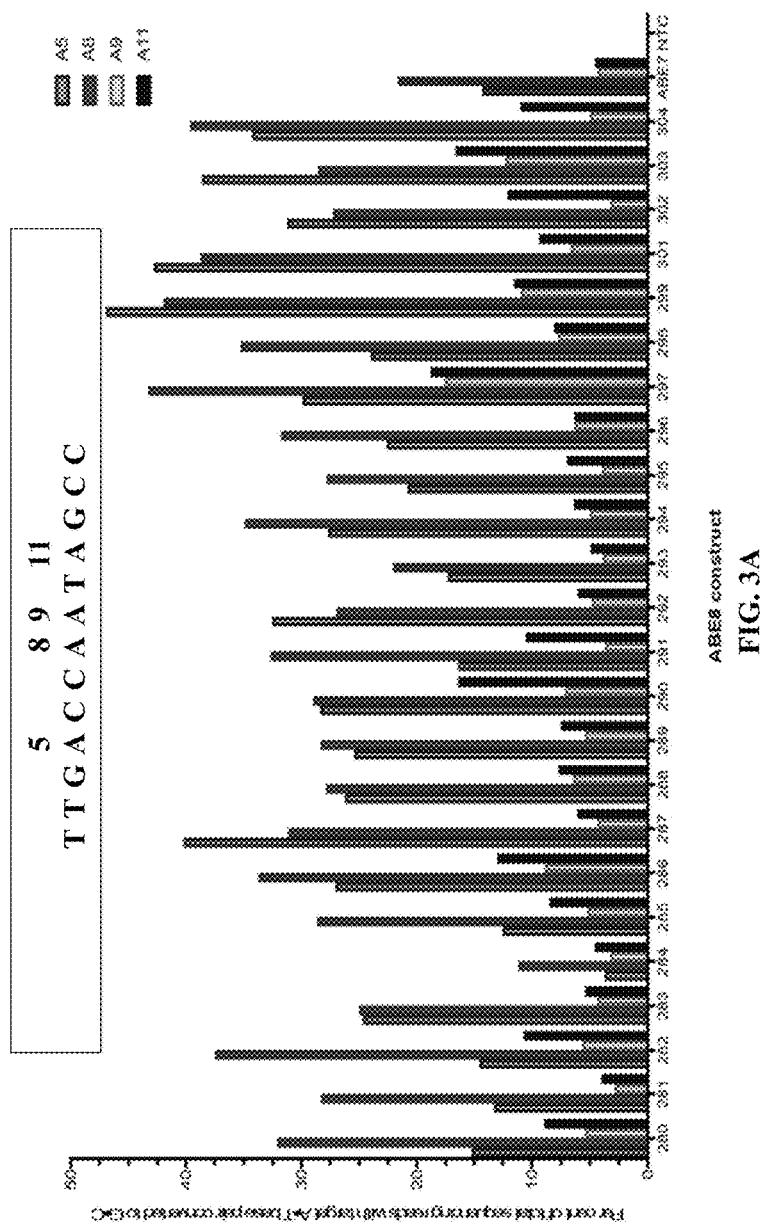
FIGS. 3A and 3B illustrate editing of a regulatory region of the hemoglobin subunit gamma (HGB1) locus, which is a therapeutically relevant site for upregulation of fetal hemoglobin.
Figure 3B:
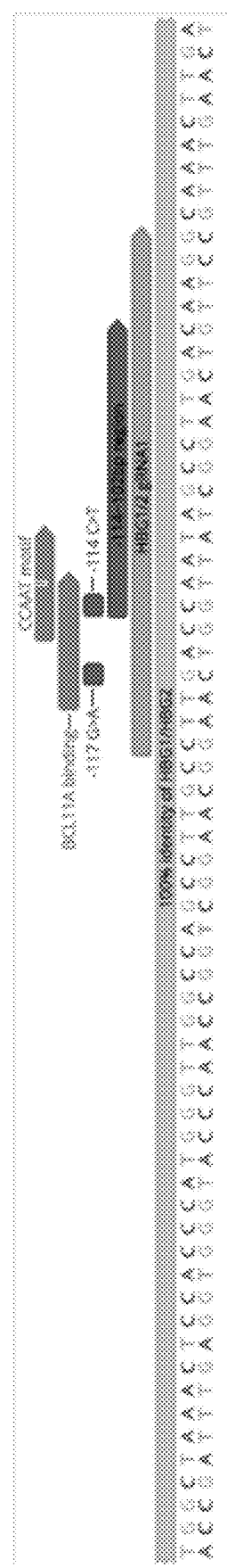

Hek293T cells expressing a β-globin protein associated with sickle cell disease that contains an E6V (also termed E7V) mutation were used to test the editing efficiency ofthe adenosine deaminase variants (FIGS. 3A and 3B). These cells termed "Hek293T/HBBE6V" cells were transduced using lentiviral vectors expressing a base editing system that includes a fusion protein comprising the ABE8s listed in Table 14. The ABE8s were generated by cloning an adenosine deaminase variant into a scaffold that included a circular permutant Cas9 and a bipartite nuclear localization sequence. Circular permutant Cas9s are known in the art and described, for example, in Oakes et al., Cell 176, 254-267, 2019. These sequences are provided herein below.

Upregulation of fetal hemoglobin is a therapeutic approach to overcoming sickle cell disease. FIG. 3A shows a therapeutically relevant site for upregulation of fetal hemoglobin. Editing adenosines at residues 5 and 8 can significantly reduce BCL11A binding, thereby increasing expression of fetal hemoglobin. Referring to FIG. 3A, the ABE8s exhibited approximately 2-3 fold more base editing activity than ABE7.10.

TABLE 14

Novel Adenine Base Editors ABE8

| plasmid ID | description | function |
|---|---|---|
| 280 | ABE8.1 | monomer_TadA*7.10 + Y147T |
| 281 | ABE8.2 | monomer_TadA*7.10 + Y147R |
| 282 | ABE8.3 | monomer_TadA*7.10 + Q154S |
| 283 | ABE8.4 | monomer_TadA*7.10 + Y123H |
| 284 | ABE8.5 | monomer_TadA*7.10 + V82S |
| 285 | ABE8.6 | monomer_TadA*7.10 + T166R |
| 286 | ABE8.7 | monomer_TadA*7.10 + Q154R |
| 287 | ABE8.8 | monomer_Y147R_Q154R_Y123H |
| 288 | ABE8.9 | monomer_Y147R_Q154R_I76Y |
| 289 | ABE8.10 | monomer_Y147R_Q154R_T166R |
| 290 | ABE8.11 | monomer_Y147T_Q154R |
| 291 | ABE8.12 | monomer_Y147T_Q154S |
| 292 | ABE8.13 | monomer_H123Y123H_Y147R_Q154R_I76Y |
| 293 | ABE8.14 | heterodimer_TadA*7.10 + Y147T |
| 294 | ABE8.15 | heterodimer_TadA*7.10 + Y147R |
| 295 | ABE8.16 | heterodimer_TadA*7.10 + Q154S |
| 296 | ABE8.17 | heterodimer_TadA*7.10 + Y123H |
| 297 | ABE8.18 | heterodimer_TadA*7.10 + V82S |
| 298 | ABE8.19 | heterodimer_TadA*7.10 + T166R |
| 299 | ABE8.20 | heterodimer_TadA*7.10 + Q154R |
| 300 | ABE8.21 | heterodimer_Y147R_Q154R_Y123H |
| 301 | ABE8.22 | heterodimer_Y147R_Q154R_I76Y |
| 302 | ABE8.23 | heterodimer_Y147R_Q154R_T166R |
| 303 | ABE8.24 | heterodimer_Y147T_Q154R |
| 304 | ABE8.25 | heterodimer_Y147T_Q154S |

Figure 4:
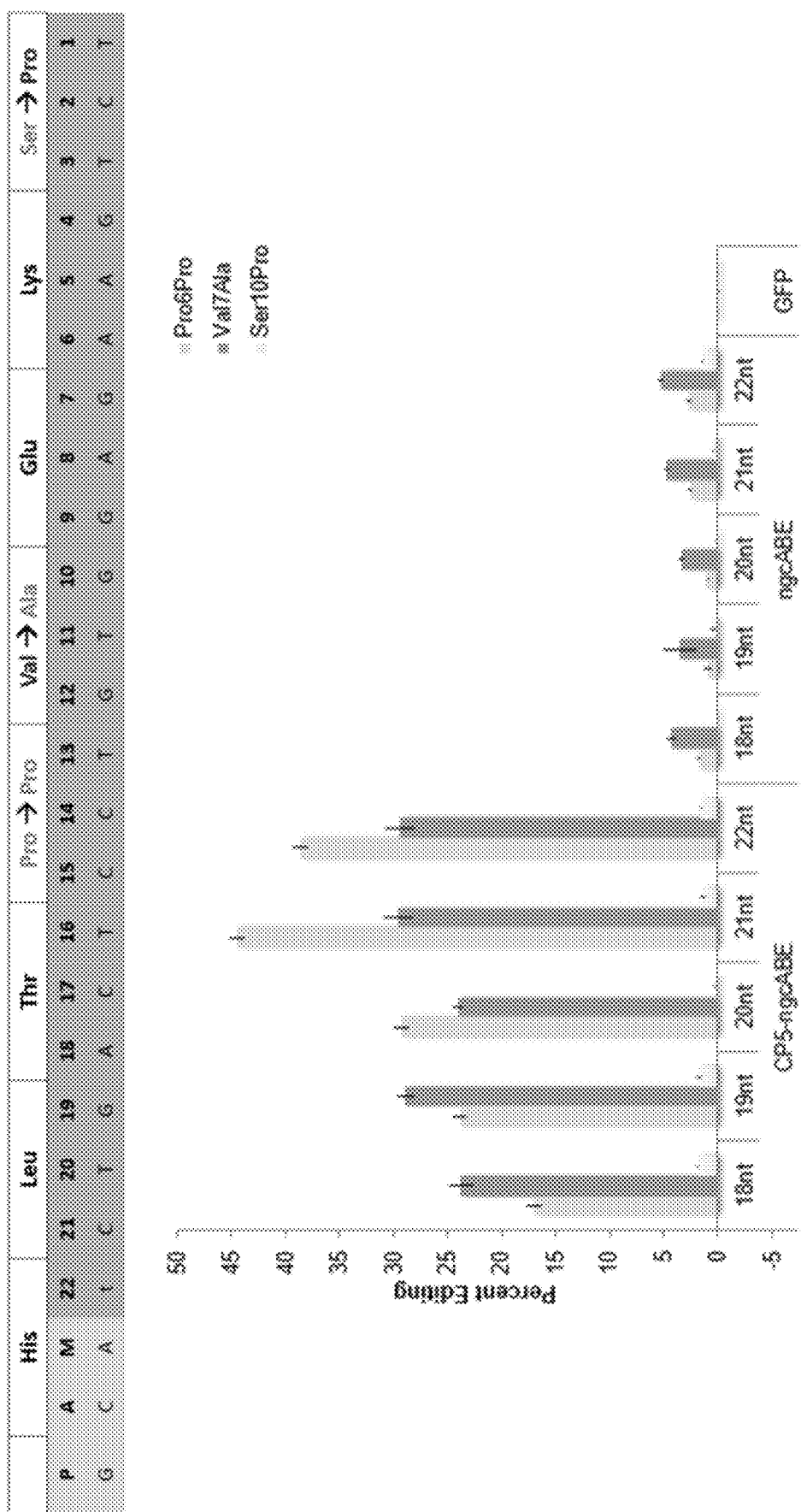
FIG. 4 illustrates the relative effectiveness of adenosine base editors comprising a dCas9 that recognizes a noncanonical PAM sequence. The top panel depicts the coding sequence of the hemoglobin subunit. The bottom panel is a graph demonstrating the efficiency of adenosine deaminase variant base editors with guide RNAs of varying lengths.
Figure 5:
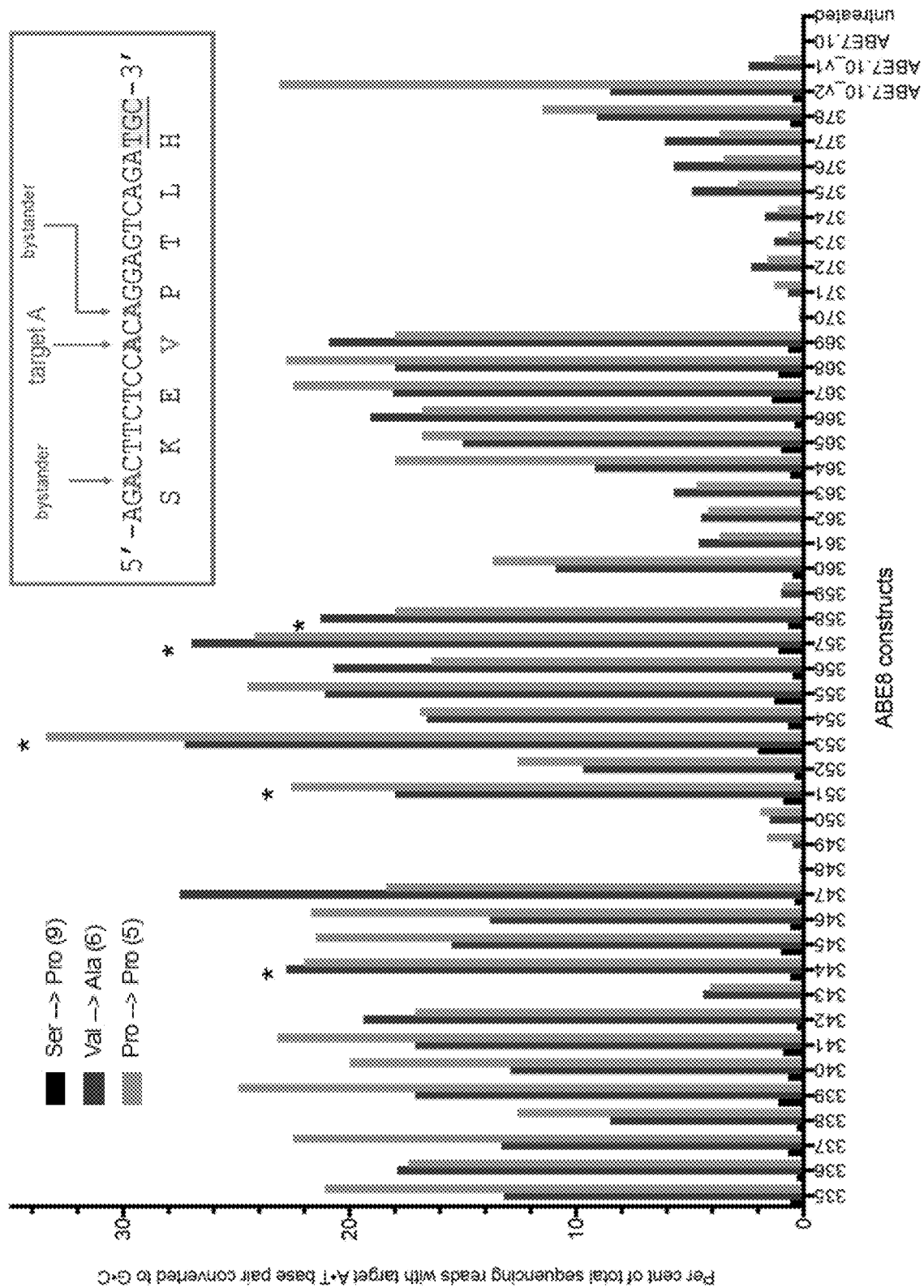
FIG. 5 is a graph illustrating the efficiency and specificity of ABE8s. The percent editing at intended target nucleotides and unintended target nucleotides (bystanders) is quantified.

Referring to FIG. 4, the ABE8s were introduced into Hek293T/HBBE6V cells along with 18, 19, 20, 21, or 22 nucleotide guide RNAs targeting the polynucleotide encoding HBB E6V. The ABE8 editors showed increased editing efficiency when fused to circular permutant (Cp)-Cas9. In total, 40 different ABE8 constructs (Table 15) and three ABE7.10 constructs were tested for editing activity in Hek293T/HBBE6V cells. The sequence of exemplary constructs follows. To evaluate the specificity of editing, target and unintended or bystander mutations were monitored (FIG. 5). Unintended editing of an adenosine in codon 5 was silent. However, unintended editing of codon 9 resulted in a serine to proline mutation. Referring again to FIG. 5, multiple ABE8s showed increased editing efficiency and specificity compared to the ABE7.10 editors, and none of the editors had significant bystander editing that led to the serine to proline missense mutation.

Figure 6:
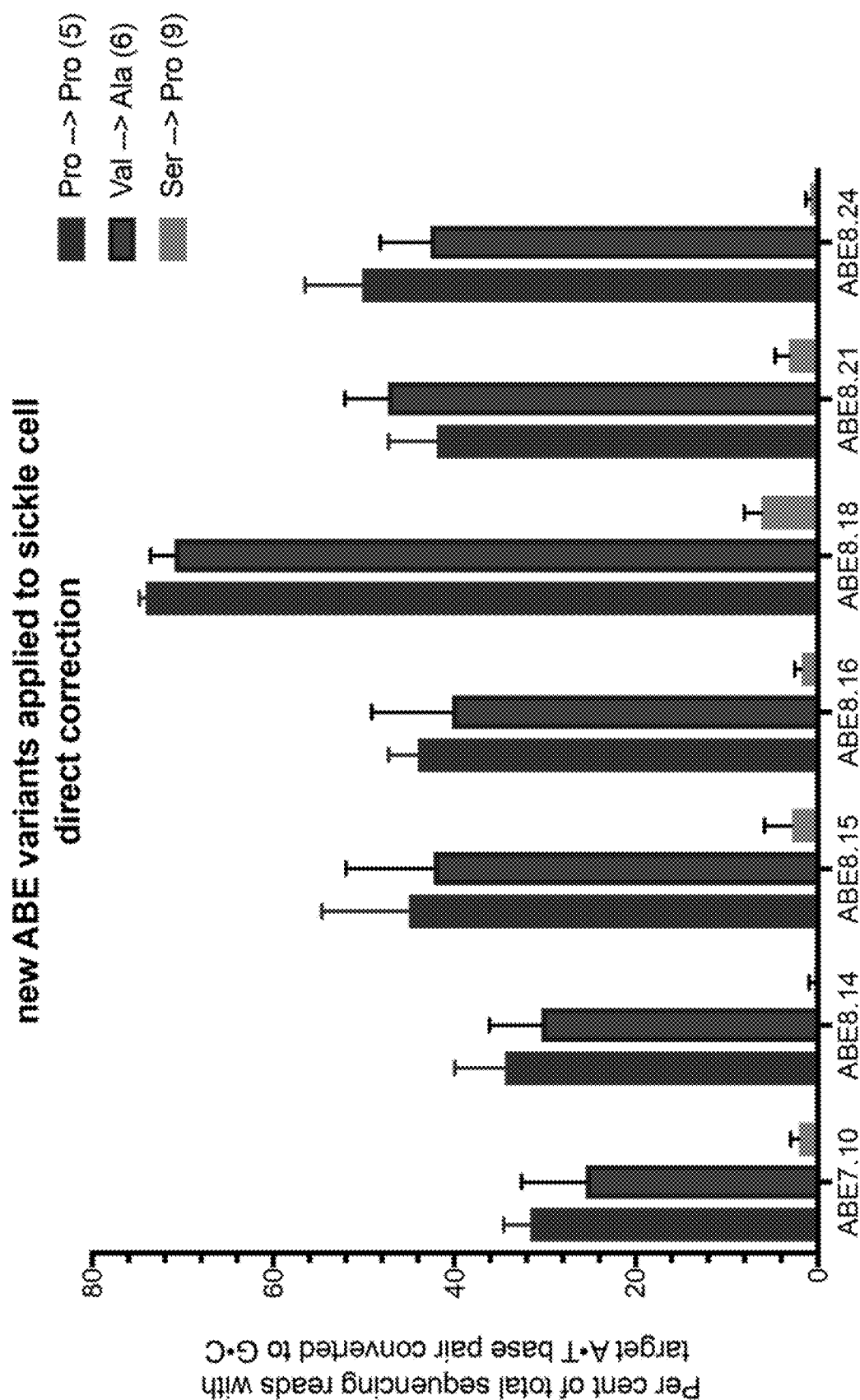
FIG. 6 is a graph illustrating the efficiency and specificity of ABE8s. The percent editing at intended target nucleotides and unintended target nucleotides (bystanders) is quantified.

Further analysis of selected ABE8s and an ABE7.10 control was carried out in fibroblast cells containing the sickle cell mutation. As shown in FIG. 6, the ABE8 editors had increased base editing activity compared to the ABE7.10. ABE8.18 showed approximately 70% efficiency. The selected ABE8 editors also displayed unprecedented specificity. Importantly, the average INDEL formation for all ABE8 editors was less than 0.1%.

TABLE 15

| plasmid ID | description | function |
|---|---|---|
| 335 | NGC PAM CP5 variant (S. pyogenes Cas9)_ABE8.1 | monomer TadA*7.10 + Y147T |
| 336 | NGC PAM CP5 variant (S. pyogrouns Cas9)_ABE8.2 | monomer TadA*7.10 + Y147R |
| 337 | NGC PAM CP5 variant (S. pyogenes Cas9)_ABE8.3 | monomer TadA*7.10 + Q154S |
| 338 | NGC PAM CP5 variant (S. pyogenes Cas9)_ABE8.4 | monomer TadA*7.10 + Y123H |
| 339 | NGC PAM CP5 variant (S. pyogenes Cas9)_ABE8.5 | monomer TadA*7.10 + V82S |
| 340 | NGC PAM CP5 variant (S. pyogenes Cas9)_ABE8.6 | monomer TadA*7.10 + T166R |
| 341 | NGC PAM CP5 variant (S. pyogenes Cas9)_ABE8.7 | monomer TadA*7.10 + Q154R |
| 342 | NGC PAM CP5 variant (S. pyogenes Cas9)_ABE8.8 | monomer_Y147R_Q154R_Y123H |
| 343 | NGC PAM CP5 variant (S. pyogenes Cas9)_ABE8.9 | monomer_Y147R_Q154R_I76Y |
| 344 | NGC PAM CP5 variant (S. pyogenes Cas9)_ABE8.10 | monomer_Y147R_Q154R_T166R |
| 345 | NGC PAM CP5 variant (S. pyogenes Cas9)_ABE8.11 | monomer_Y147T_Q154R |
| 346 | NGC PAM CP5 variant (S. pyogenes Cas9)_ABE8.12 | monomer_Y147T_Q154S |
| 347 | NGC PAM CP5 variant (S. pyogenes Cas9)_ABE8.13 | monomer_H123Y123H_Y147R_Q154R_I76Y |
| 348 | NGC PAM CP5 variant (S. pyogenes Cas9)_ABE7.10 | monomer_deletion at TadA7.10* residue 149 |
| 349 | NGC PAM CP5 variant (S. pyogenes Cas9)_ABE7.10 | monomer_deletion at TadA7.10* residue 150 |
| 350 | NGC PAM CP5 variant (S. pyogenes Cas9)_ABE7.10 | monomer_deletion at TadA7.10* residue 151 |
| 351 | NGC PAM CP5 variant (S. pyogenes Cas9)_ABE7.10 | monomer_deletion at TadA7.10* residue 152 |
| 352 | NGC PAM CP5 variant (S. pyogenes Cas9)_ABE7.10 | monomer_deletion at TadA7.10* residue 153 |
| 353 | NGC PAM CP5 variant (S. pyogenes Cas9)_ABE7.10 | monomer_deletion at TadA7.10* residue 154 |
| 354 | NGC PAM CP5 variant (S. pyogenes Cas9)_ABE7.10 | monomer_deletion at TadA7.10* residue 155 |
| 355 | NGC PAM CP5 variant (S. pyogenes Cas9)_ABE7.10 | monomer_deletion at TadA7.10* residue 156 |
| 356 | NGC PAM CP5 variant (S. pyogenes Cas9)_ABE7.10 | monomer_deletion at TadA7.10* residue 157 |
| 357 | NGC PAM CP5 variant (S. pyogenes Cas9)_ABE8.14 | heterodimer_TadA*7.10 + Y147T |
| 358 | NGC PAM CP5 variant (S. pyogenes Cas9)_ABE8.15 | heterodimer_TadA*7.10 + Y147R |
| 359 | NGC PAM CP5 variant (S. pyogenes Cas9)_ABE8.16 | heterodimer_TadA*7.10 + Q154S |
| 360 | NGC PAM CP5 variant (S. pyogenes Cas9)_ABE8.17 | heterodimer_TadA*7.10 + Y123H |
| 361 | NGC PAM CP5 variant (S. pyogenes Cas9)_ABE8.18 | heterodimer_TadA*7.10 + V82S |
| 362 | NGC PAM CP5 variant (S. pyogenes Cas9)_ABE8.19 | heterodimer_TadA*7.10 + T166R |
| 363 | NGC PAM CP5 variant (S. pyogenes Cas9)_ABE8.20 | heterodimer_TadA*7.10 + Q154R |
| 364 | NGC PAM CP5 variant (S. pyogenes Cas9)_ABE8.21 | heterodimer_Y147R_Q154R_Y123H |
| 365 | NGC PAM CP5 variant (S. pyogenes Cas9)_ABE8.22 | heterodimer_Y147R_Q154R_I76Y |
| 366 | NGC PAM CP5 variant (S. pyogenes Cas9)_ABE8.23 | heterodimer_Y147R_Q154R_T166R |
| 367 | NGC PAM CP5 variant (S. pyogenes Cas9)_ABE8.24 | heterodimer_Y147T_Q154R |
| 368 | NGC PAM CP5 variant (S. pyogenes Cas9)_ABE8.25 | heterodimer_Y147T_Q154S |
| 369 | NGC PAM CP5 variant (S. pyogenes Cas9)_ABE8.26 | heterodimer_H123Y123H_Y147R_Q154R_I76Y |
| 370 | NGC PAM CP5 variant (S. pyogenes Cas9)_ABE7.10 | heterodimer_deletion at TadA7.10* residue 149 |
| 371 | NGC PAM CP5 variant (S. pyogenes Cas9)_ABE7.10 | heterodimer_deletion at TadA7.10* residue 150 |
| 372 | NGC PAM CP5 variant (S. pyogenes Cas9)_ABE7.10 | heterodimer_deletion at TadA7.10* residue 151 |
| 373 | NGC PAM CP5 variant (S. pyogenes Cas9)_ABE7.10 | heterodimer_deletion at TadA7.10* residue 152 |
| 374 | NGC PAM CP5 variant (S. pyogenes Cas9)_ABE7.10 | heterodimer_deletion at TadA7.10* residue 153 |
| 375 | NGC PAM CP5 variant (S. pyogenes Cas9)_ABE7.10 | heterodimer_deletion at TadA7.10* residue 154 |

TABLE 15-continued

| plasmid ID | description | function |
|---|---|---|
| 376 | NGC PAM CP5 variant (*S. pyogenes* Cas9)_ABE7.10 | heterodimer_deletion at TadA7.10* residue 155 |
| 377 | NGC PAM CP5 variant (*S. pyogenes* Cas9)_ABE7.10 | heterodimer_deletion at TadA7.10* residue 156 |
| 378 | NGC PAM CP5 variant (*S. pyogenes* Cas9)_ABE7.10 | heterodimer_deletion at TadA7.10* residue 157 |

Example 2: Codon Optimization and NLS Choice for ABE8 Design

It has been established that Cas9 codon usage and nuclear localization sequence can dramatically alter genome editing efficiencies in eukaryotes (see e.g., Kim, S. et al., Rescue of high-specificity Cas9 variants using sgRNAs with matched 5' nucleotides. Genome Biol 18, 218, doi:10.1186/s13059-017-1355-3 (2017); Mikami, M. et al., Comparison of CRISPR/Cas9 expression constructs for efficient targeted mutagenesis in rice. Plant Mol Biol 88, 561-572, doi: 10.1007/s11103-015-0342-x (2015); Jinek, M. et al., RNA-programmed genome editing in human cells. Elife 2, e00471, doi:10.7554/eLife.00471 (2013)). The original Cas9n component of base editors contains six potential polyadenylation sites, leading to poor expression in eukaryotes (see e.g., Kim, S. et al., Rescue of high-specificity Cas9 variants using sgRNAs with matched 5' nucleotides. Genome Biol 18, 218, doi:10.1186/s13059-017-1355-3 (2017); Komor, A. C. et al., Programmable editing of a target base in genomic DNA without double-stranded DNA cleavage. Nature 533, 420-424, doi:10.1038/nature17946 (2016); Gaudelli, N. M. et al. Programmable base editing of A*T to G*C in genomic DNA without DNA cleavage. Nature 551, 464-471, doi:10.1038/nature24644 (2017)). Replacing this with an extensively optimized codon sequence improves base editing efficiencies (see e.g., Cong, L. et al. Multiplex genome engineering using CRISPR/Cas systems. Science 339, 819-823, doi:10.1126/science.1231143 (2013); Koblan, L. W. et al. Improving cytidine and adenine base editors by expression optimization and ancestral reconstruction. Nat Biotechnol, doi:10.1038/nbt.4172 (2018); Zafra, M. P. et al. Optimized base editors enable efficient editing in cells, organoids and mice. Nat Biotechnol, doi:10.1038/nbt.4194 (2018)).

DNA on-target (FIG. 9A, 9B), DNA off-target (FIG. 9C, 9D) and RNA off-target (FIG. 9E) base editing frequencies associated with four ABE constructs were assessed, all of which contain a codon-optimized Cas9(D10A) (Cong, L. et al. Multiplex genome engineering using CRISPR/Cas systems. Science 339, 819-823, doi: 10.1126/science.1231143 (2013)): i) ABE7.10, which has a single C-terminal BP-SV40 NLS; ii) monoABE7.10 which lacks the 5' TadA wild-type portion of ABE7.10; iii) ABEmax, which contains codon-optimized TadA regions and two BPNLS sequences; and iv) ABEmax(-BPNLS), which has the TadA codon optimization as ABEmax but contains a single C-terminal BP-SV40 NLS.

Figure 9A:
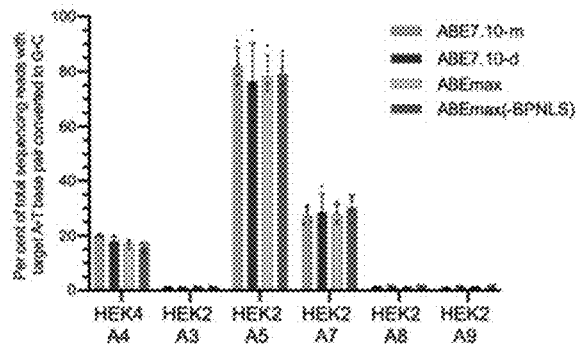
FIGS. 9A-9F depict the comparison between the on- and off-target editing frequencies between ABE7.10, ABEmax and ABEmax with one BPNLS in Hek293T cells. Individual data points are shown and error bars represent s.d. for n=3 or n=4 independent biological replicates, performed on different days.
Figure 9B:
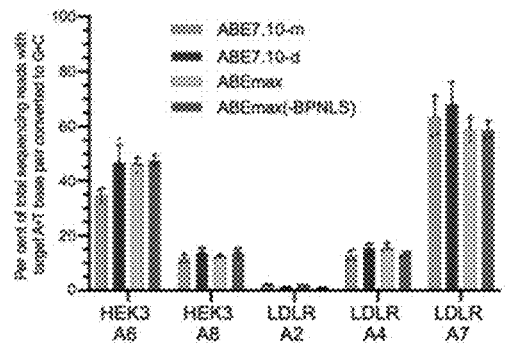
Figure 9C:
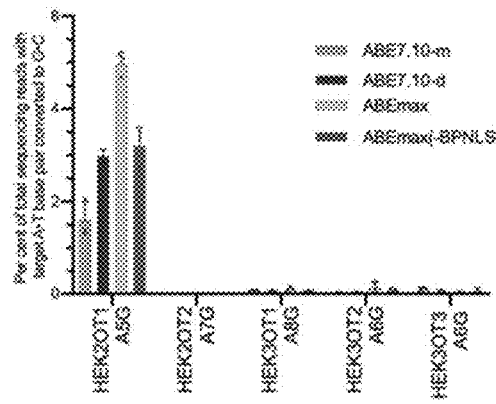
Figure 9D:
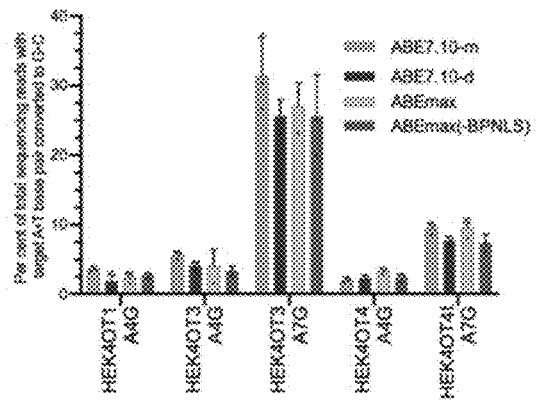
Figure 9E:
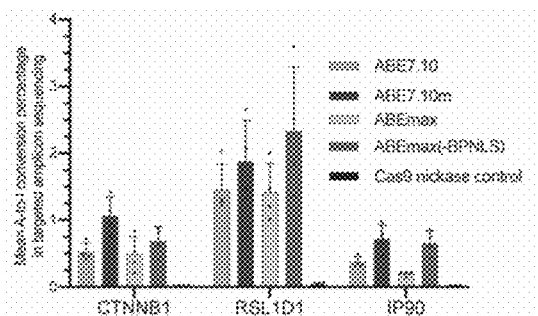
Figure 9F:
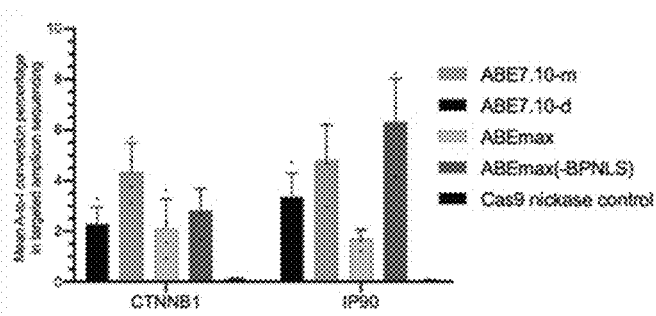
Figure 10A:
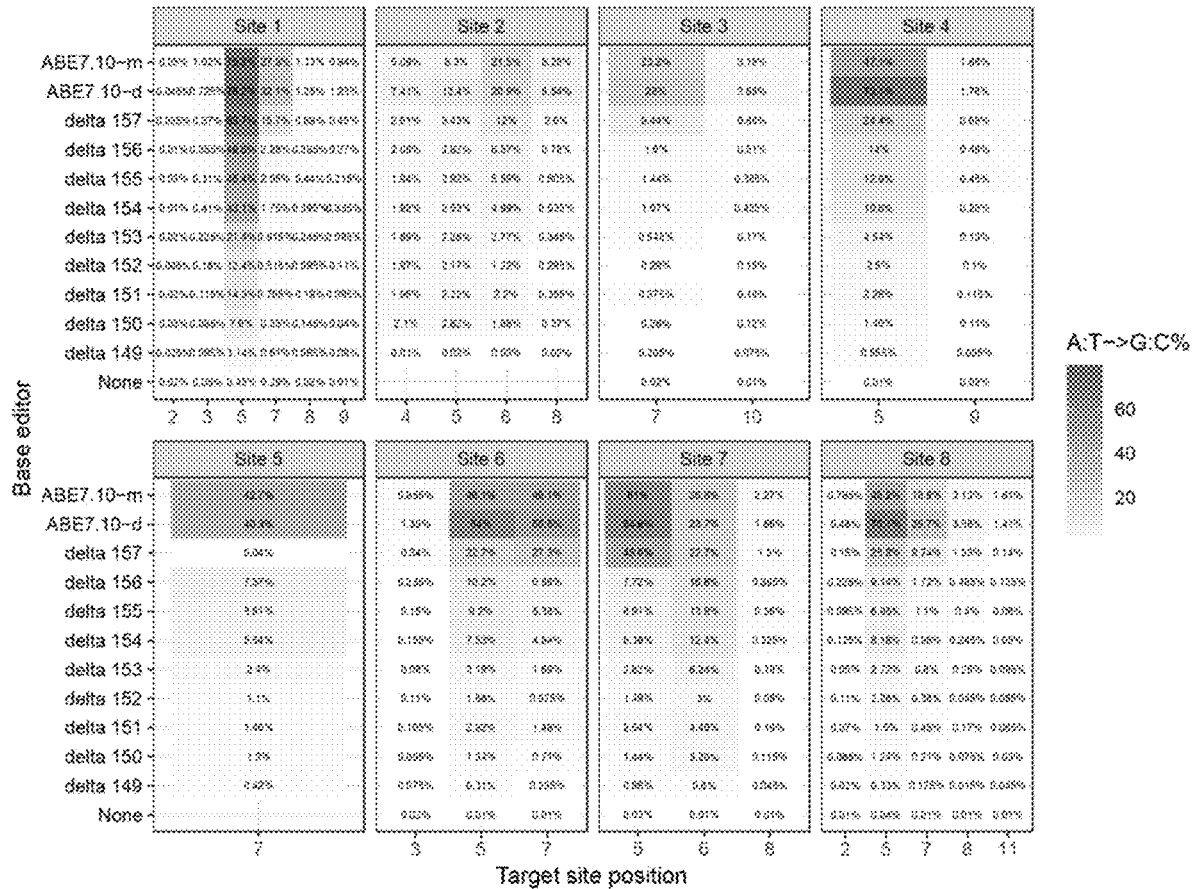
FIGS. 10A-10D depict the median A•T to G•C conversion and corresponding INDEL formation of TadA, C-terminal alpha-helix truncation ABE constructs in HEK293T cells.
Figure 10B:
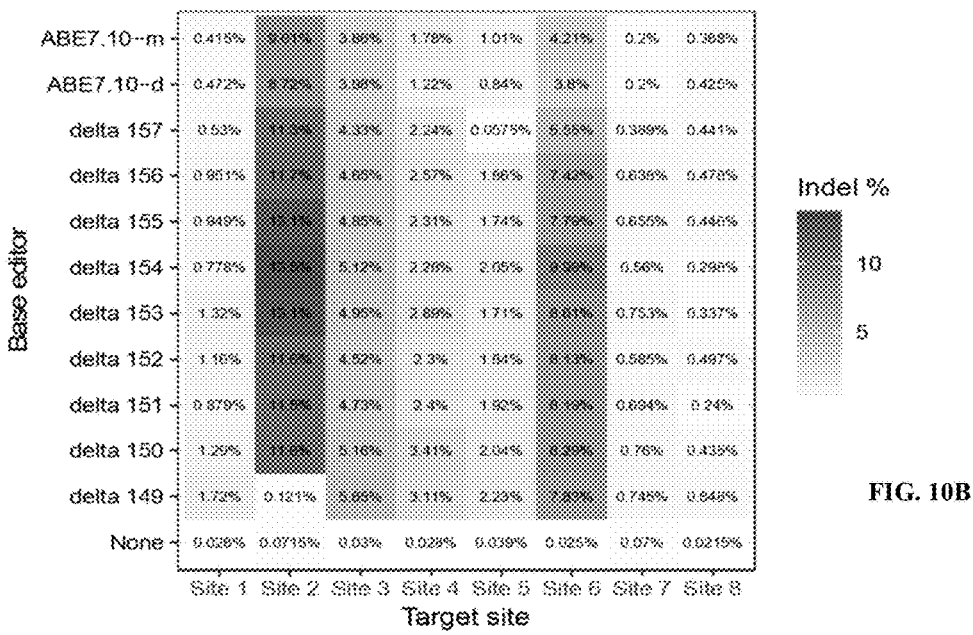
Figure 10C:
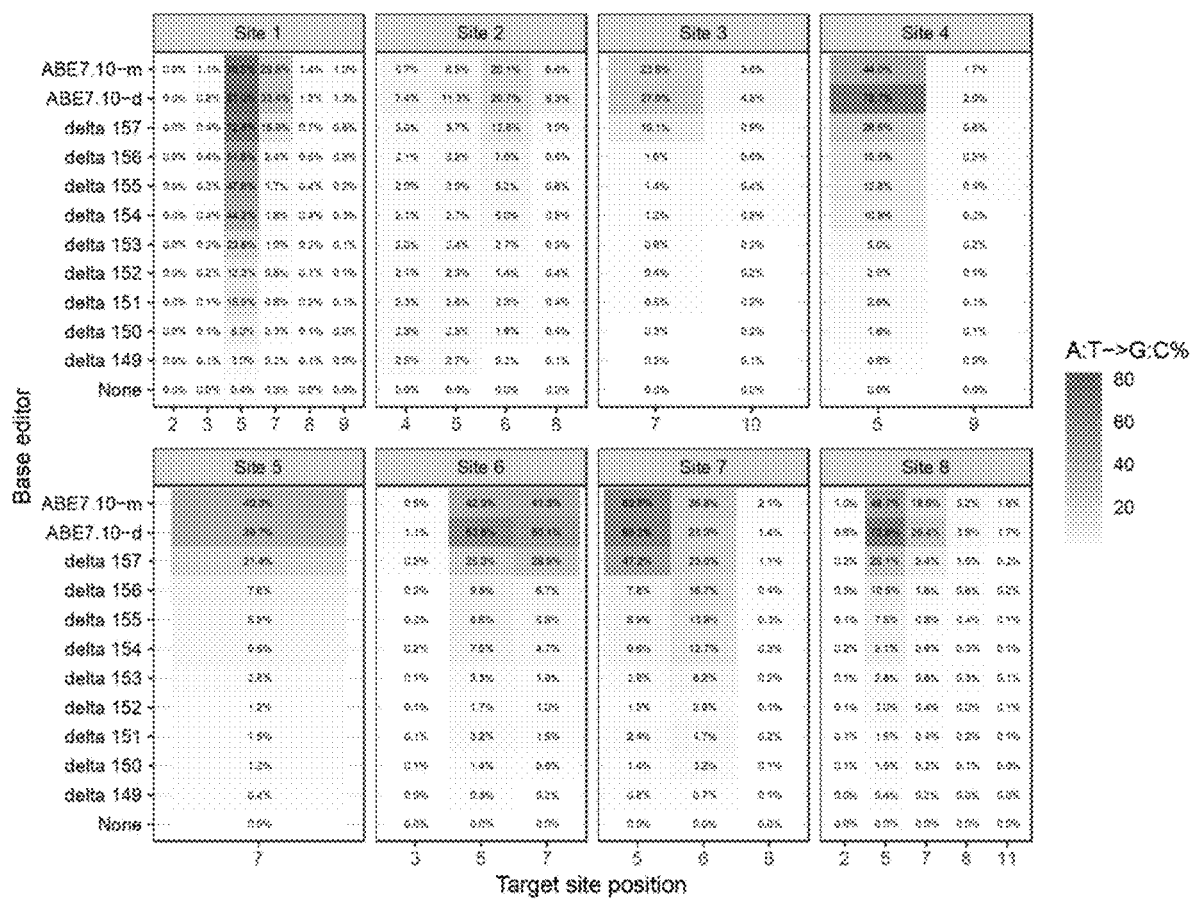
Figure 10D:
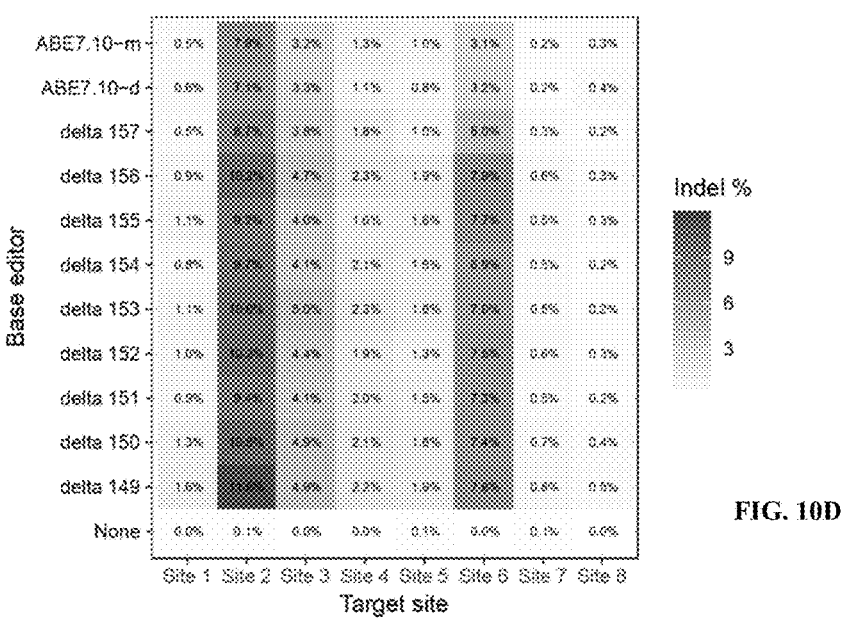

All four constructs displayed remarkably similar on-target editing efficiencies, indicating that the NLS architecture and TadA codon optimization are not determining for on-target editing efficiency (FIG. 9A, 9B). The off-target profiles were also highly similar, but ABEmax displayed greater DNA off-target editing (p=0.00027, Students' two-tailed T test) at one site when compared to ABE7.10 (FIG. 9C, 9D). ABEmax(-NBPNLS) displayed a 1.6-fold greater mean frequency of RNA off-target editing than ABE7.10 (FIG. 9E). There was no difference in on-target editing efficiency with 2×BPNLS.

Example 3: Superior Adenine Base Editors with Expanded Targeting Range

Figure 7A:
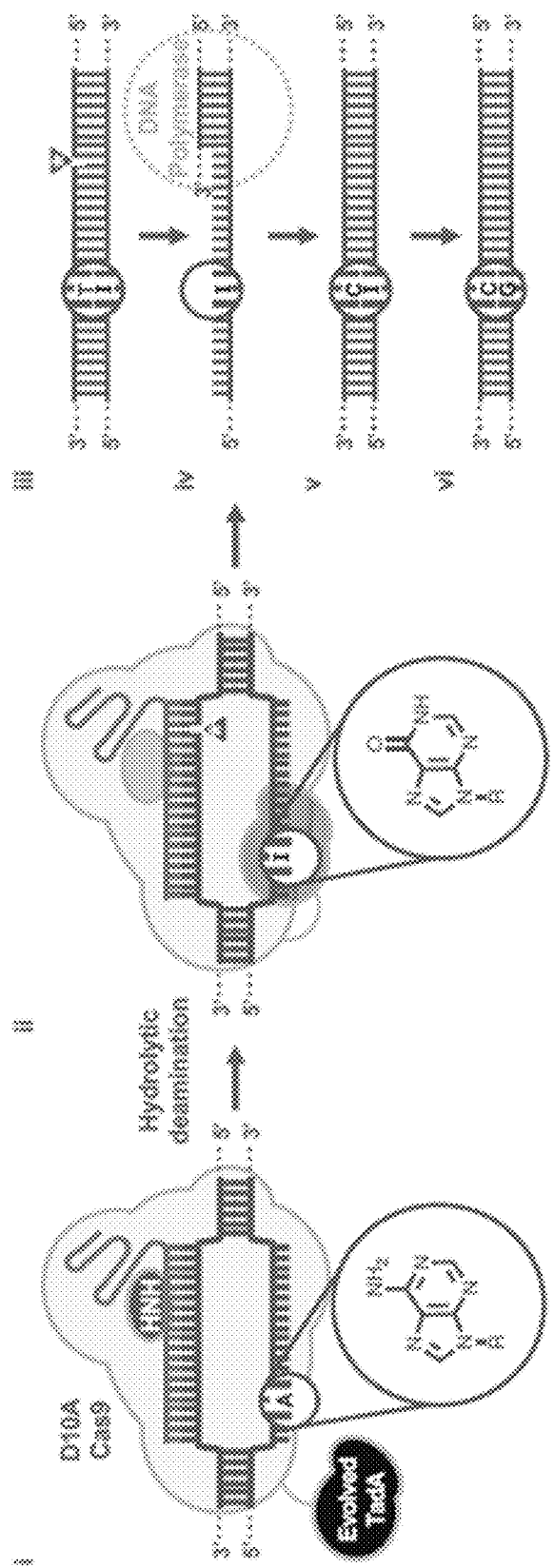
FIGS. 7A-7E depict eighth generation adenine base editors mediate superior A•T to G•C conversion in human cells.
Figure 7B:
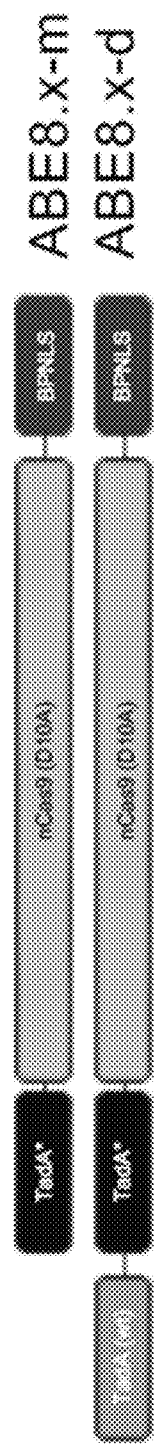

Adenine base editors (ABE) allow the efficient programmable conversion of adenine to guanine in target DNA without creating double strand breaks (DSBs) (Gaudelli, N. M. et al. Programmable base editing of A*T to G*C in genomic DNA without DNA cleavage. Nature 551, 464-471, doi:10.1038/nature24644 (2017); Komor, A. C., et al. Programmable editing of a target base in genomic DNA without double-stranded DNA cleavage. Nature 533, 420-424, doi: 10.1038/nature17946 (2016); Rees, H. A. & Liu, D. R. Base editing: precision chemistry on the genome and transcriptome of living cells. Nat Rev Genet 19, 770-788, doi: 10.1038/s41576-018-0059-1 (2018)). ABE is a molecular machine comprising an evolved *E. coli* tRNA$^{ARG}$ modifying enzyme, TadA, covalently fused to a catalytically-impaired Cas9 protein (D10A nickase Cas9, nCas9) (FIGS. 7A and 7B). A guide RNA (gRNA) directs ABE to a target genomic DNA sequence and, upon binding and stable R-loop formation, a short stretch of single-stranded nucleotides becomes accessible to TadA, which chemically converts adenine to inosine. Inosine exclusively base-pairs with cytosine in DNA polymerase binding pockets (Yasui, M. et al. Miscoding properties of 2'-deoxyinosine, a nitric oxide-derived DNA Adduct, during translesion synthesis catalyzed by human DNA polymerases. J Mol Biol 377, 1015-1023, doi:10.1016/j.jmb.2008.01.033 (2008)), resulting in an ABE-catalyzed A•T to G•C transition mutation at user-defined base-pairs following DNA replication or strand resection and nick repair (FIG. 7A).

Seventh generation ABEs (ABE7) have enabled efficient A•T to G•C conversion in the genomes of humans (Zeng, Y. et al. Correction of the Marfan Syndrome Pathogenic FBN1 Mutation by Base Editing in Human Cells and Heterozygous Embryos. Molecular Therapy, doi:10.1016/j.ymthe.2018.08.007 (2018)), mice (Liu, Z. et al. Highly efficient RNA-guided base editing in rabbit. Nat Commun 9, 2717, doi:10.1038/s41467-018-05232-2 (2018); Song, C.-Q. et al. Adenine base editing in an adult mouse model of tyrosinaemia. Nature Biomedical Engineering, doi:10.1038/s41551-019-0357-8 (2019); Ryu, S. M. et al. Adenine base editing in mouse embryos and an adult mouse model of Duchenne muscular dystrophy. Nat Biotechnol, doi: 10.1038/nbt.4148 (2018)), bacteria (Gaudelli, N. M. et al. Programmable base editing of A*T to G*C in genomic DNA without DNA cleavage. Nature 551, 464-471, doi:10.1038/nature24644 (2017)), plants (Hua, K., et al. Precise A.T to G.C Base Editing in the Rice Genome. Mol Plant 11, 627-630, doi:10.1016/j.molp.2018.02.007 (2018); Yan, F. et al. Highly Efficient A.T to G.C Base Editing by Cas9n-Guided tRNA Adenosine Deaminase in Rice. Mol Plant 11, 631-634, doi:10.1016/j.molp.2018.02.008 (2018)), and a variety of other species (Rees, H. A. & Liu, D. R. Publisher Correction: Base editing: precision chemistry on the genome and transcriptome of living cells. Nat Rev Genet 19, 801, doi:10.1038/s41576-018-0068-0 (2018)). However, in some circumstances, it may be beneficial to engineer base editors, such as ABE7s, to have, for example, modified base editing windows, improved compatibility with non-NGG Cas9 variants (see e.g., Huang, T. P. et al. Circularly permuted and PAM-modified Cas9 variants broaden the targeting scope of base editors. Nat Biotechnol 37, 626-631, doi:10.1038/s41587-019-0134-y (2019); Hua, K., Tao, X. & Zhu, J. K. Expanding the base editing scope in rice by using Cas9 variants. Plant Biotechnol J, doi:10.1111/pbi.12993 (2018); Yang, L. et al. Increasing targeting scope of adenosine base editors in mouse and rat embryos through fusion of TadA deaminase with Cas9 variants. Protein Cell 9, 814-819, doi:10.1007/s13238-018-0568-x (2018)), improved base editing efficiencies, such as in human cell lines (see e.g., Rees, H. A., et al. Development of hRad51-Cas9 nickase fusions that mediate HDR without double-stranded breaks. Nat Commun 10, 2212, doi:10.1038/s41467-019-09983-4 (2019)) or when used in vivo (see e.g., Ryu, S. M. et al. Adenine base editing in mouse embryos and an adult mouse model of Duchenne muscular dystrophy. Nat Biotechnol, doi:10.1038/nbt.4148 (2018)) and/or when the target adenines are positioned on the outer edges of the canonical ABE editing window (positions 3, 4, 7 and 8).

Figure 7C:
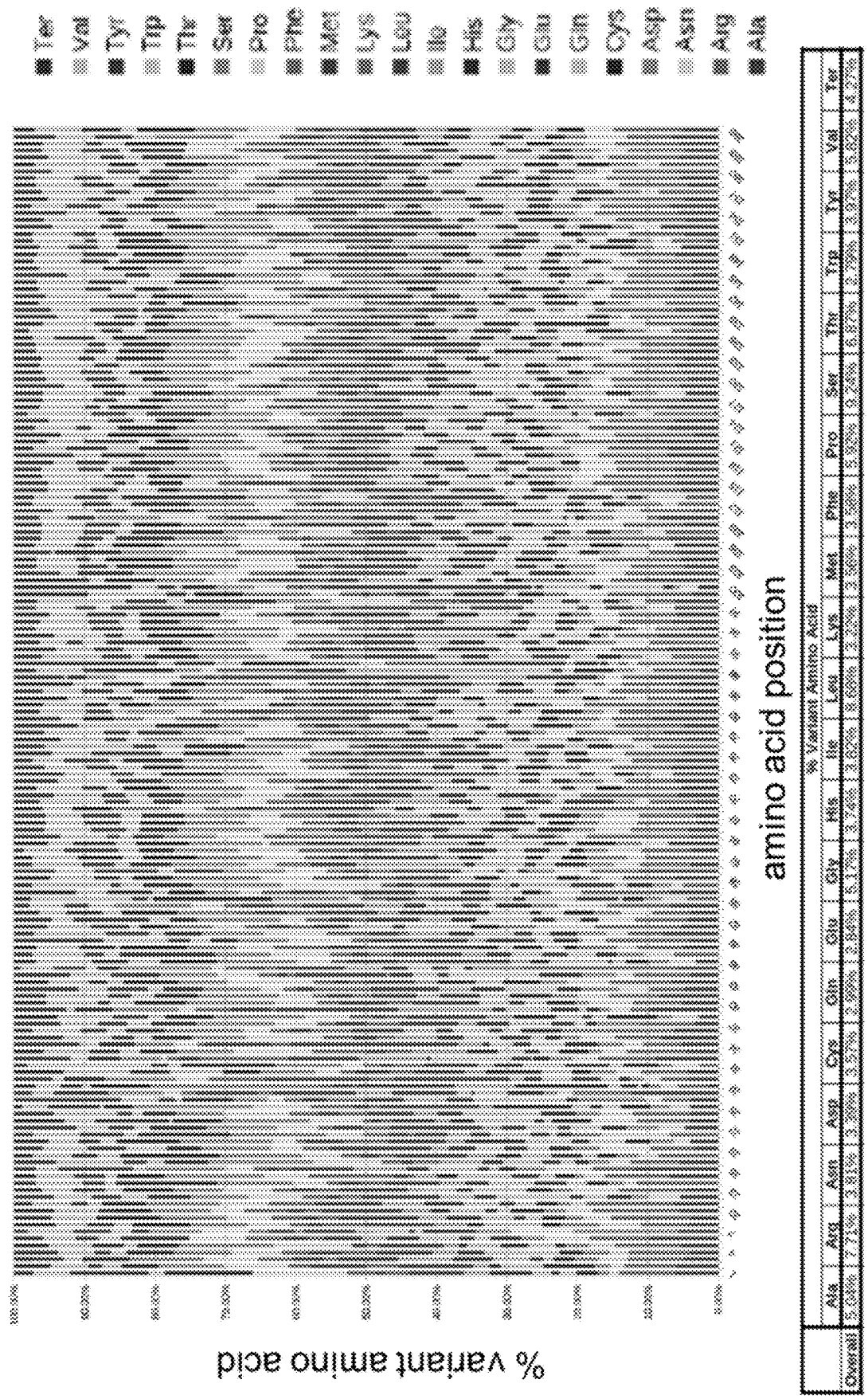

To improve prior adenine base editors, the stringency of the bacterial selection system (see Gaudelli, N. M. et al. Programmable base editing of A*T to G*C in genomic DNA without DNA cleavage. Nature 551, 464-471, doi:10.1038/nature24644 (2017)) was increased by designing ABEs that must make three concurrent A•T to G•C reversion edits to survive antibiotic selection (FIGS. 2B and 2C). In the prior ABE evolutions, TadA libraries were created via error-prone PCR. Contrastingly, a synthetic library of TadA alleles was utilized containing all 20 canonical amino acid substitutions at each position of TadA, with an average frequency of 1-2 nucleotide substitution mutations per library member (FIG. 7C). This chemically-synthesized library enabled access to a greater sequence space than is achievable with error-prone PCR techniques (see Gaudelli, N. M. et al. Programmable base editing of A*T to G*C in genomic DNA without DNA cleavage. Nature 551, 464-471, doi:10.1038/nature24644 (2017)).

Figure 7D:
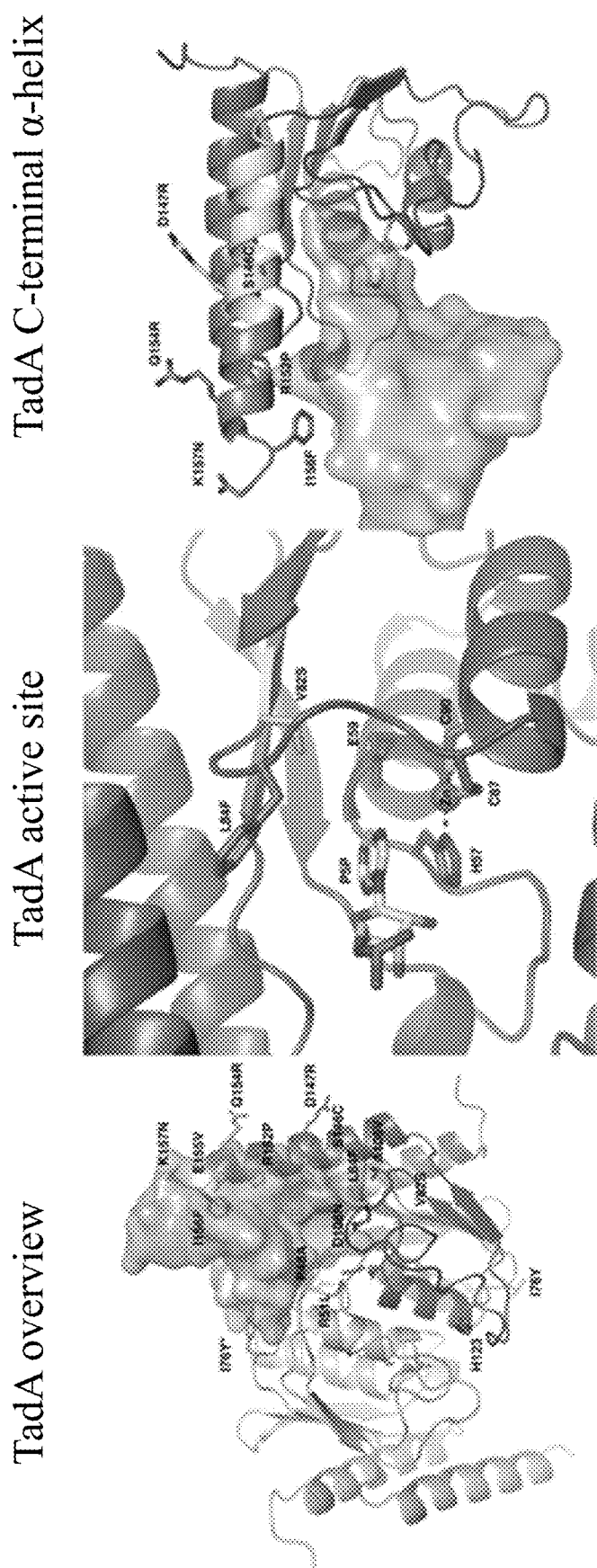
Figure 7E:
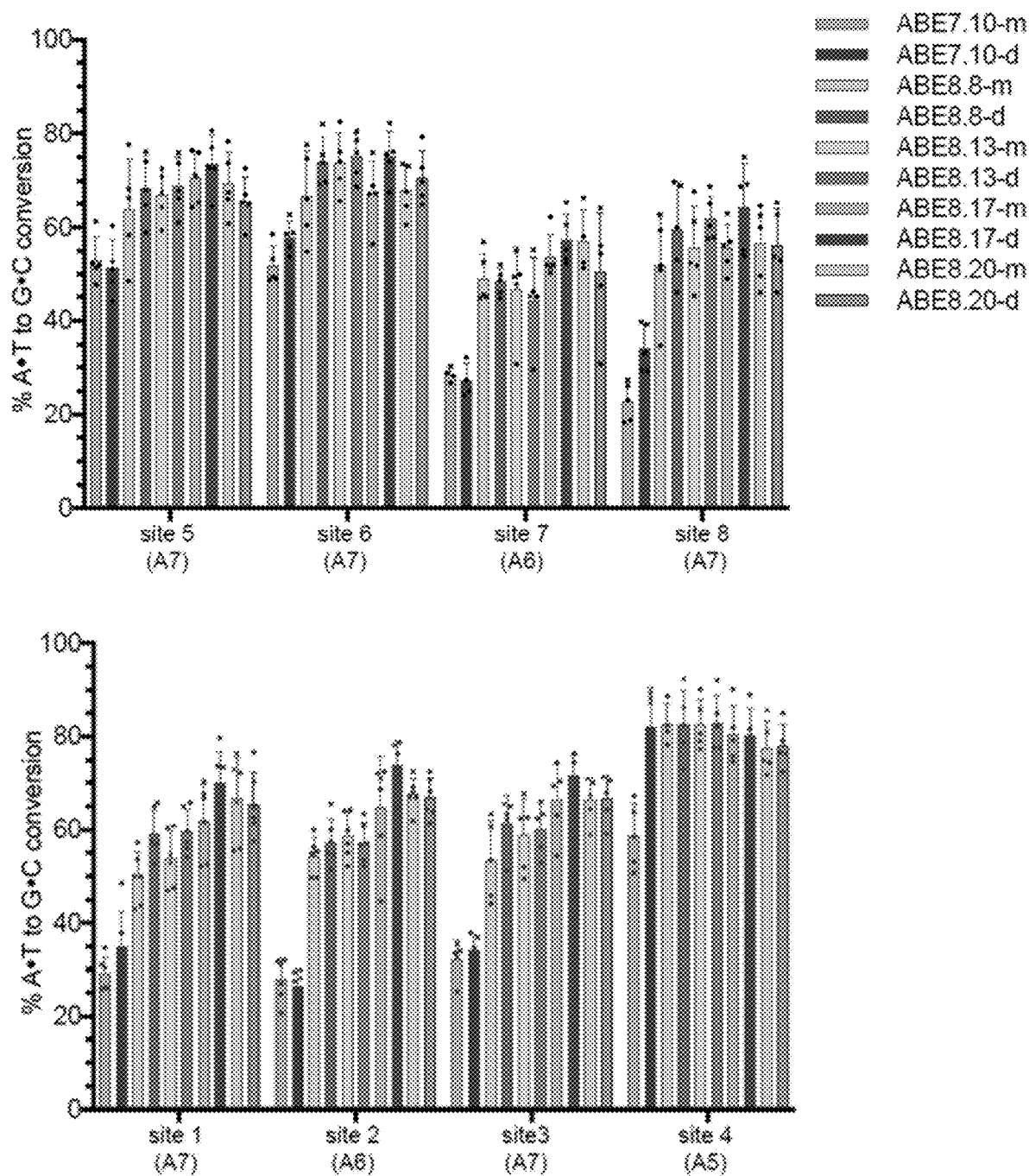
Figure 8A:
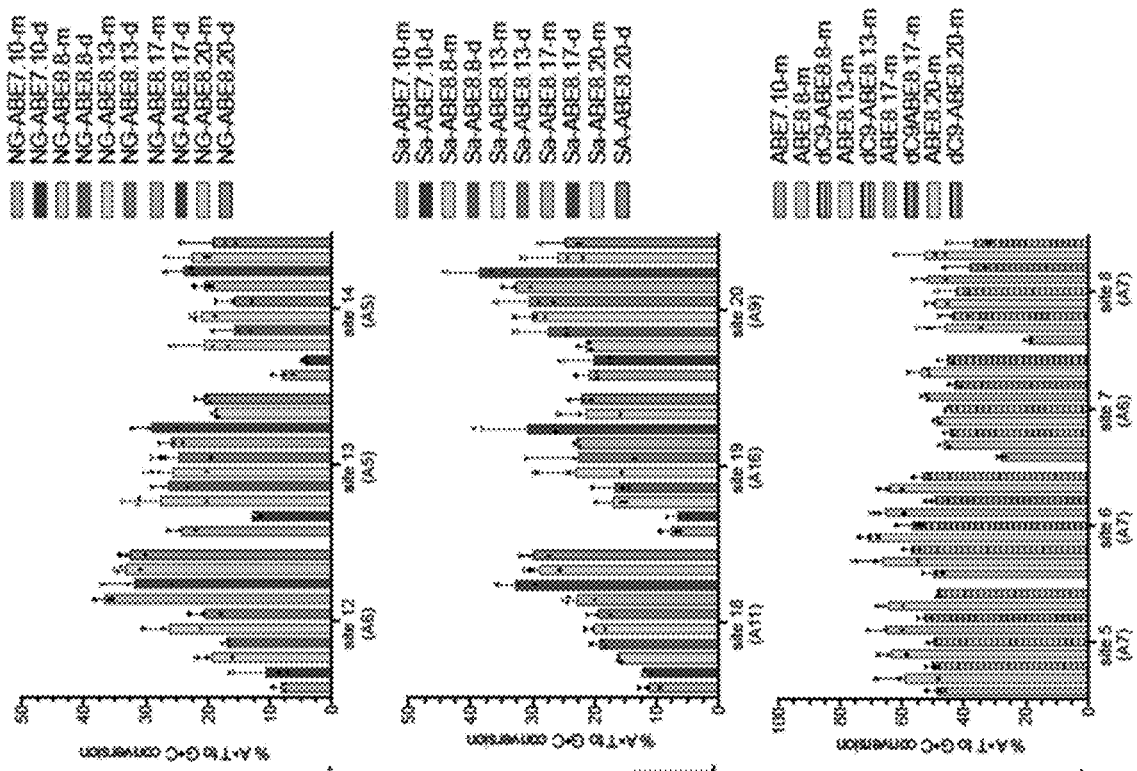
FIGS. 8A-8C depict Cas9 PAM-variant ABE8s and catalytically dead Cas9 ABE8 variants mediate higher A•T to G•C conversion than corresponding ABE7.10 variants in human cells. Values and error bars reflect the mean and s.d. of three independent biological replicates performed on different days. ABE7.10 and ABE8 editor activity windows are shown. Numbers indicate the position within the protospacer. The location of an induced nick in the target DNA backbone is indicated by a triangle and corresponding PAM recognition sequence is shown.
Figure 8A:
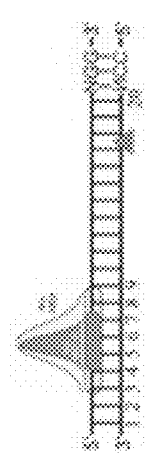
Figure 8B:
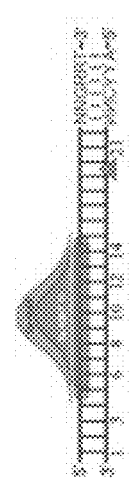
Figure 8C:
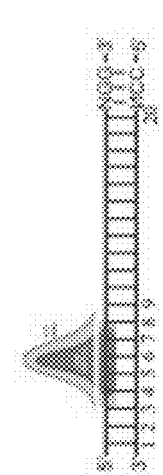

About 300 clones were isolated and subsequently sequenced. From the resultant sequencing data, eight mutations were identified within TadA* that were enriched with high frequency (Tables 7 and 9). Six of the eight identified amino acid mutations required at least two nucleobase changes per codon, which were unobserved with the previous TadA error-prone libraries. Two of the enriched mutations alter residues proximal to the active site of adenine deamination (I76 and V82) (FIG. 7D). In addition to the four previously reported mutations in the C-terminal alpha helix of TadA*7.10, two new mutations were observed within the same alpha-helix (Y147R and Q154R) (FIG. 7D). This highly mutated alpha-helix is necessary for robust product formation because upon truncation, base editing efficiency was substantially reduced (FIGS. 10A-10D).

To test the activity of TadA* variants in mammalian cells, ABE codon optimization and NLS orientation was utilized with the most favorable on- and off-target profile (see Example 2; FIGS. 9A-9E). The eight enriched TadA* mutations were incorporated into ABE7.10 in various combinations, yielding forty (40) new ABE8 variants (Tables 7 and 9). Two architectural variants of ABE8 constructs were made where the TadA region of ABE is either heterodimeric fusion of a wild-type (TadA) and evolved (TadA*) protomer or a single protomer of an engineered TadA*, resulting in about a 500 base-pair smaller editor. These architectural variants are referred to as ABE8.x-d and ABE8.x-m respectively (Tables 7 and 9).

Figure 11A:
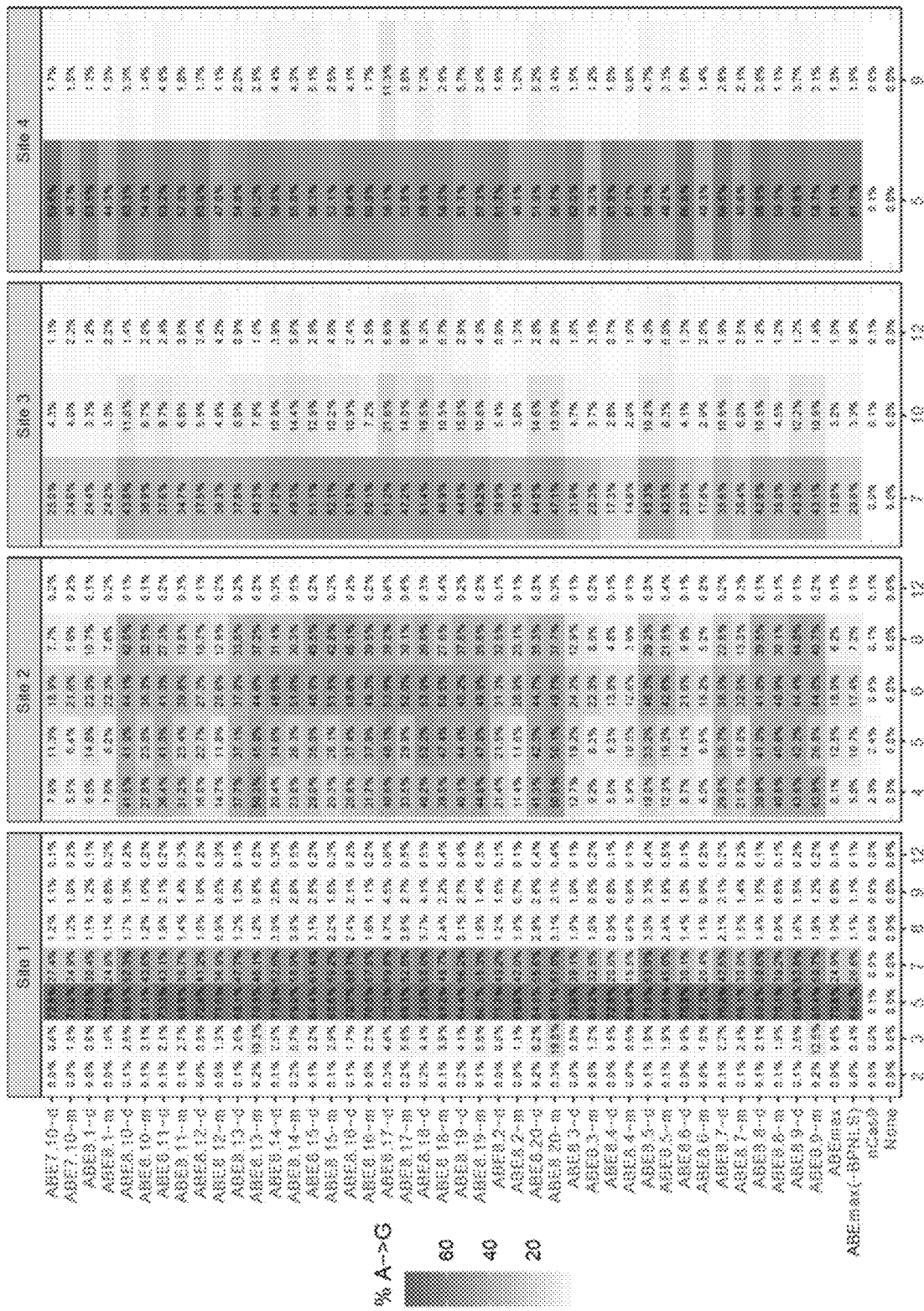
FIGS. 11A and 11B are heat maps depicting the median A•T to G•C conversion of forty (40) ABE8 constructs in HEK293T cells across 8 genomic sites. Median values were determined from n=3 or greater biological replicates.
Figure 11B:
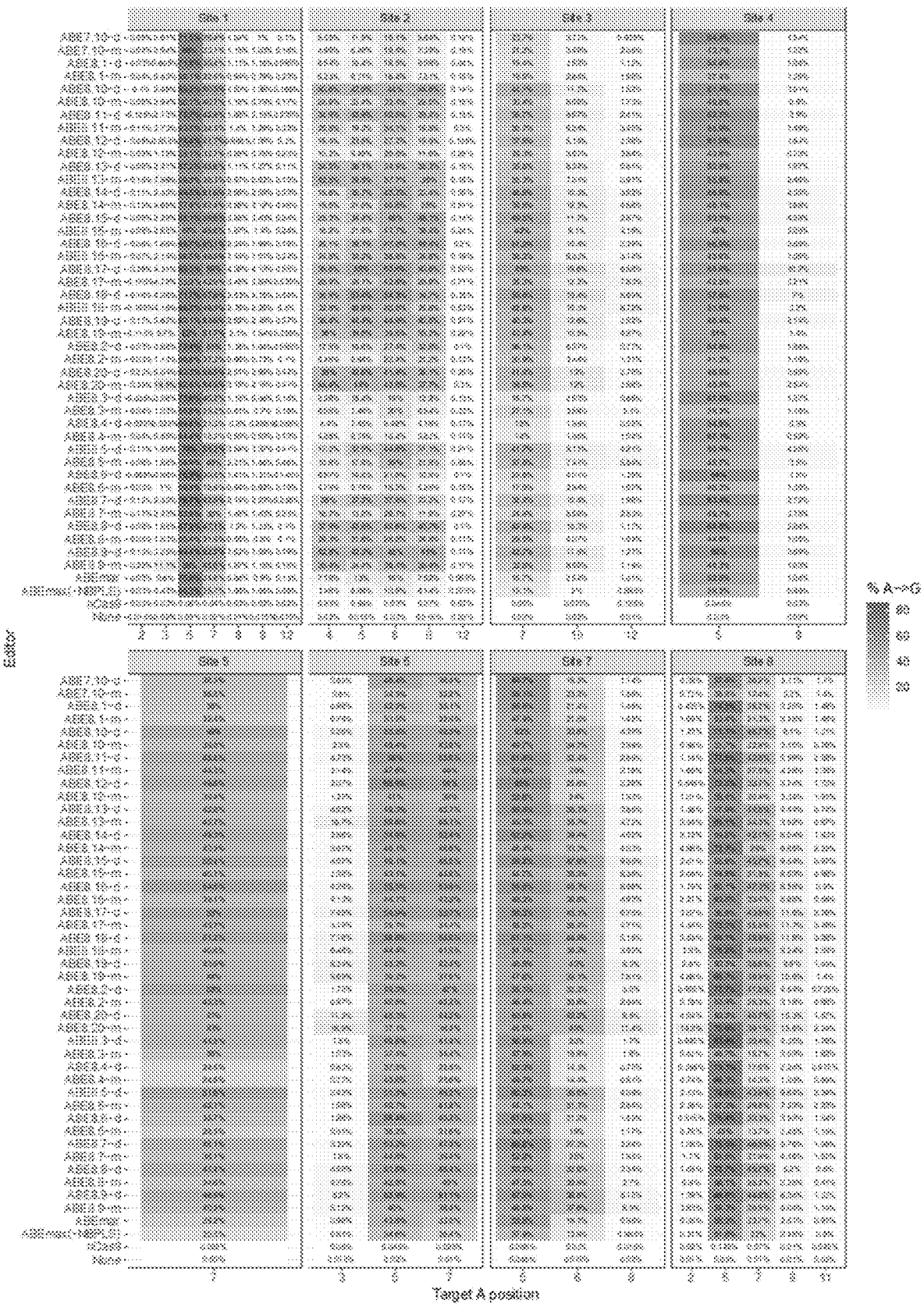
Figure 12:
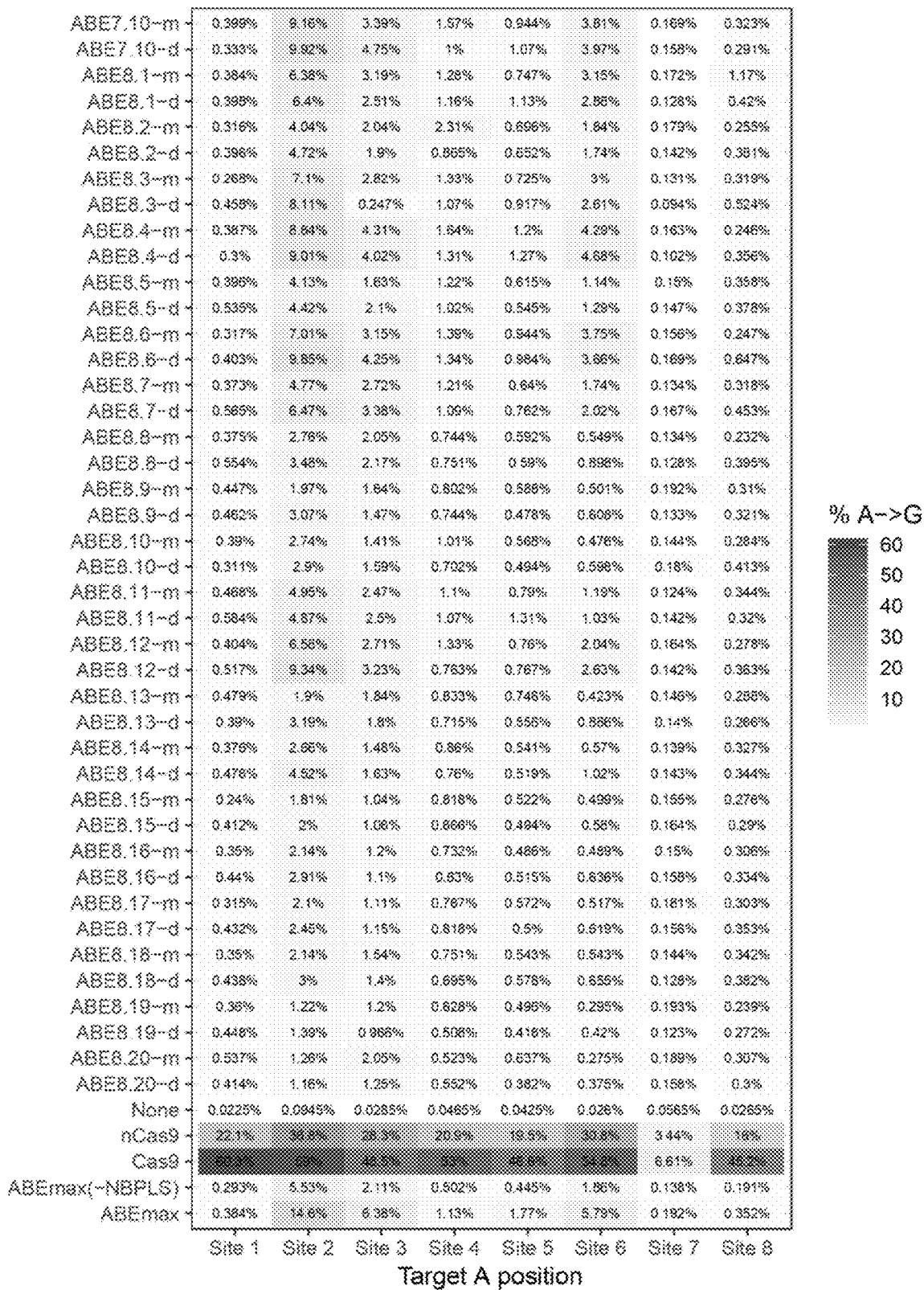
FIG. 12 is a heat map depicting median INDEL % of 40 ABE8 constructs in HEK293T cells across 8 genomic sites. Median values were determined from two or greater biological replicates.

First, these forty (40) constructs were evaluated for their on-target DNA editing efficiencies relative to ABE7.10 across eight genomic sites containing target "A" bases in positions which range from 2 to 20 (where NGG PAM=positions 21, 22, 23) within the canonical 20-nt *S. pyogenes* protospacer (FIGS. 11A and 11B). The N-terminal wild-type TadA construct was not necessary for robust DNA editing using ABE8 (see also Grunewald, J. et al. CRISPR DNA base editors with reduced RNA off-target and self-editing activities. Nat Biotechnol 37, 1041-1048, doi: 10.1038/s41587-019-0236-6 (2019); Rees, H. A., et al. Analysis and minimization of cellular RNA editing by DNA adenine base editors. Sci Adv 5, eaax5717, doi:10.1126/sciadv.aax5717 (2019); Hua, K. et al. Simplified adenine base editors improve adenine base editing efficiency in rice. Plant Biotechnol J, doi:10.1111/pbi.13244 (2019)). Constructs containing the N-terminal, wild-type TadA (ABE8.x-d) perform similarly in terms of both editing window preference, total DNA editing outcome, and INDEL frequency relative to its economized architecture (ABE8.x-m) (FIG. 7E, FIGS. 11A and 11B, FIG. 12). Although intra-construct TadA(wt):TadA*8 dimerization may not be necessary for ABE8 activity, it does not preclude the possibility of in trans TadA*8:TadA*8 dimerization occurring between ABE8 expressed base editors as has been observed in plant nuclei (Hua, K. et al. Simplified adenine base editors improve adenine base editing efficiency in rice. Plant Biotechnol J, doi:10.1111/pbi.13244 (2019)).

Figure 13:
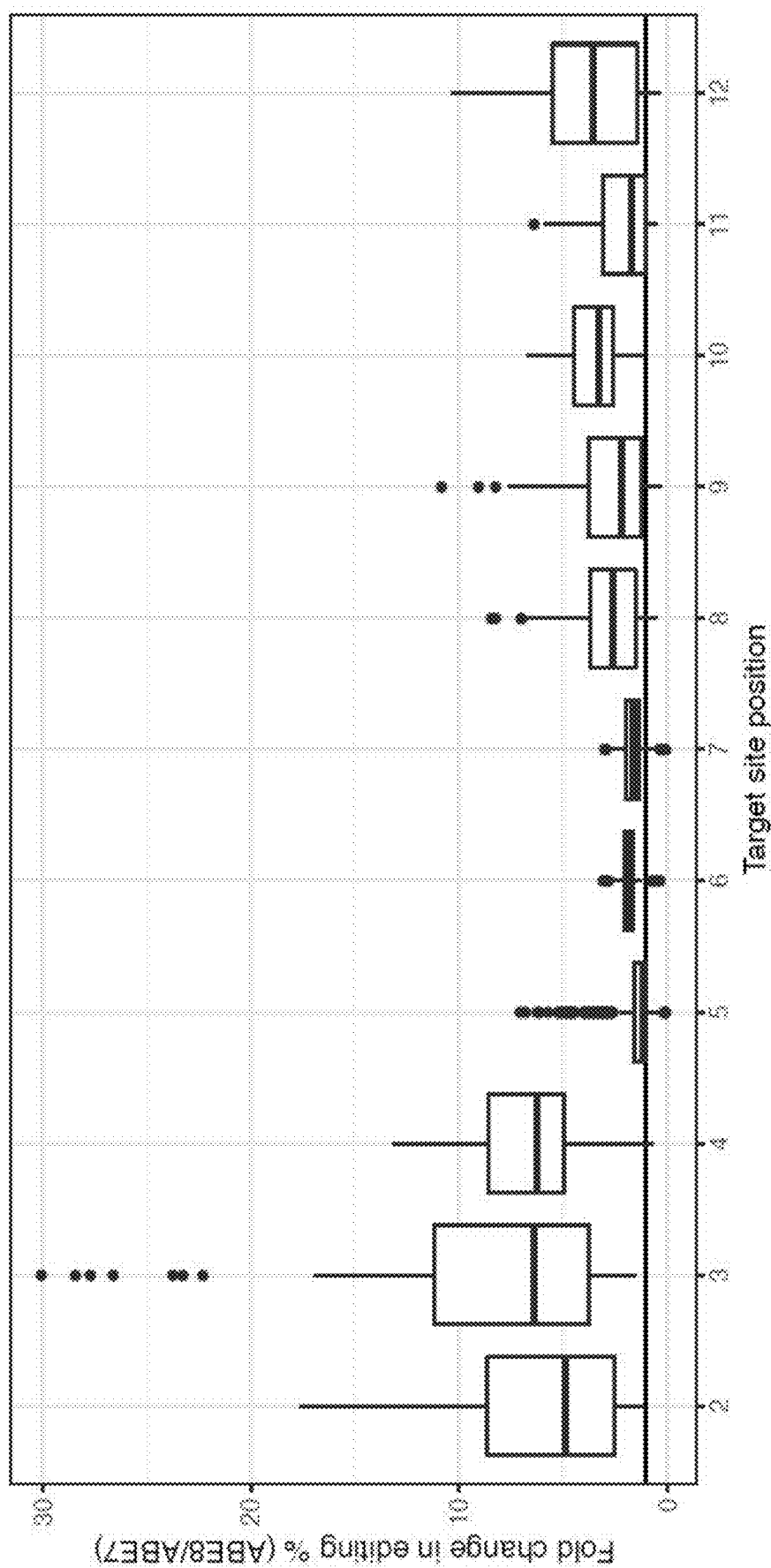
FIG. 13 is a graph depicting fold change in editing, ABE8:ABE7. Representation of average ABE8:ABE7 A•T to G•C editing in Hek293T cells across all A positions within the target of eight different genomic sites. Positions 2-12 denote location of a target adenine within the 20-nt protospacer with position 20 directly 5' of the -NGG PAM.
Figure 54A:
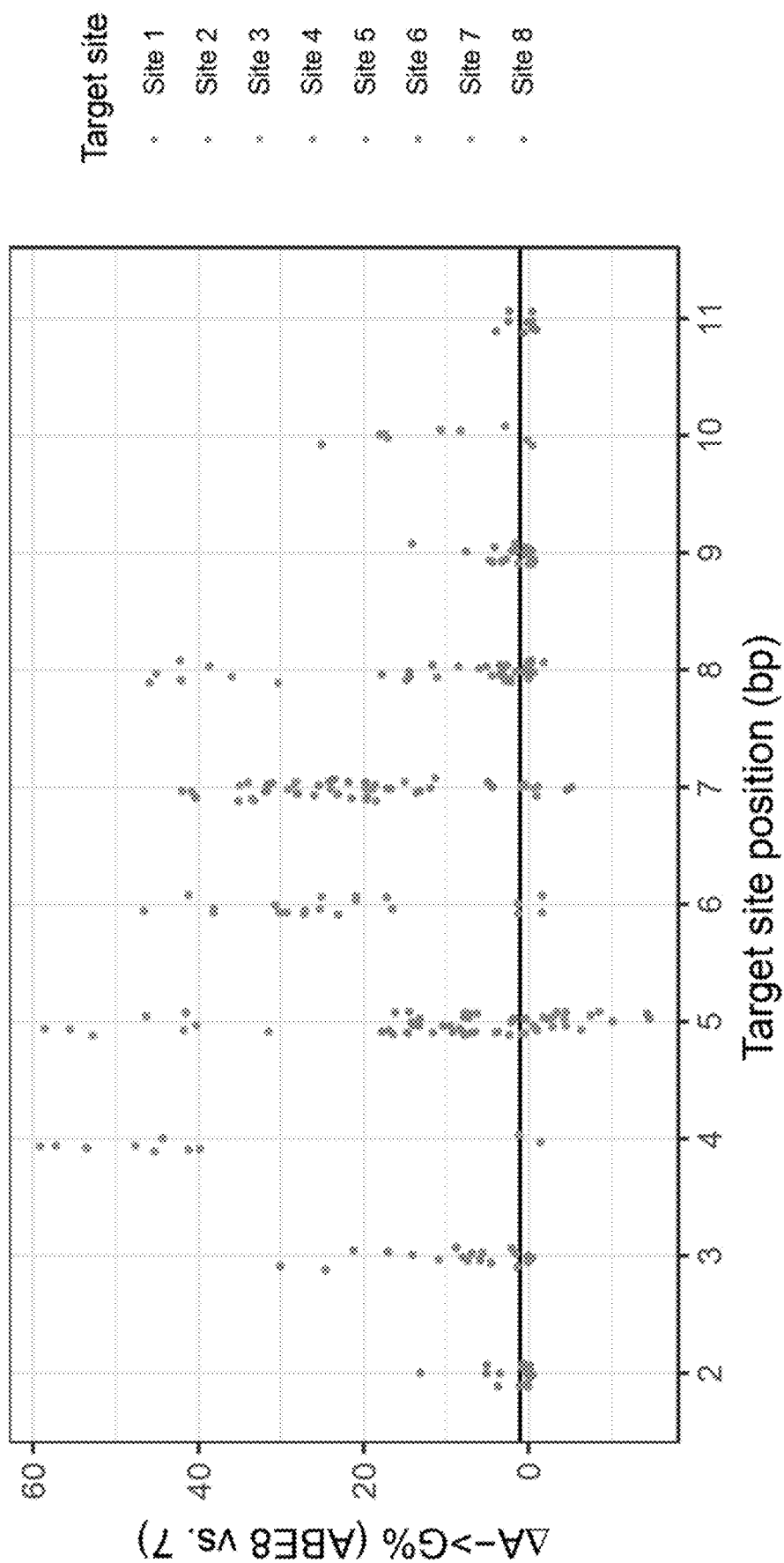
FIGS. 54A-54C depict eighth generation adenine base editors mediate superior A•T to G•C conversion in human cells.
Figure 54B:
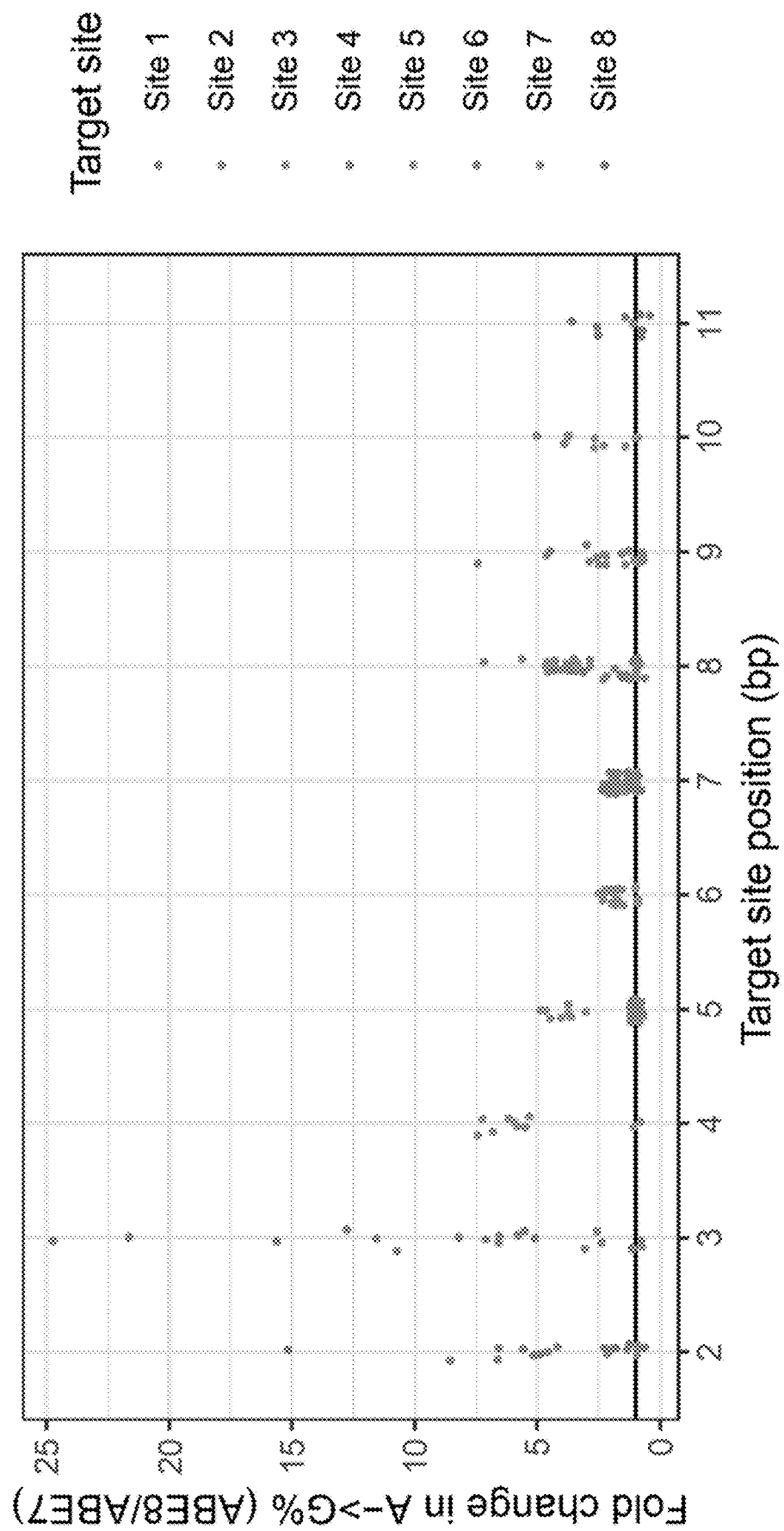
Figure 54C:
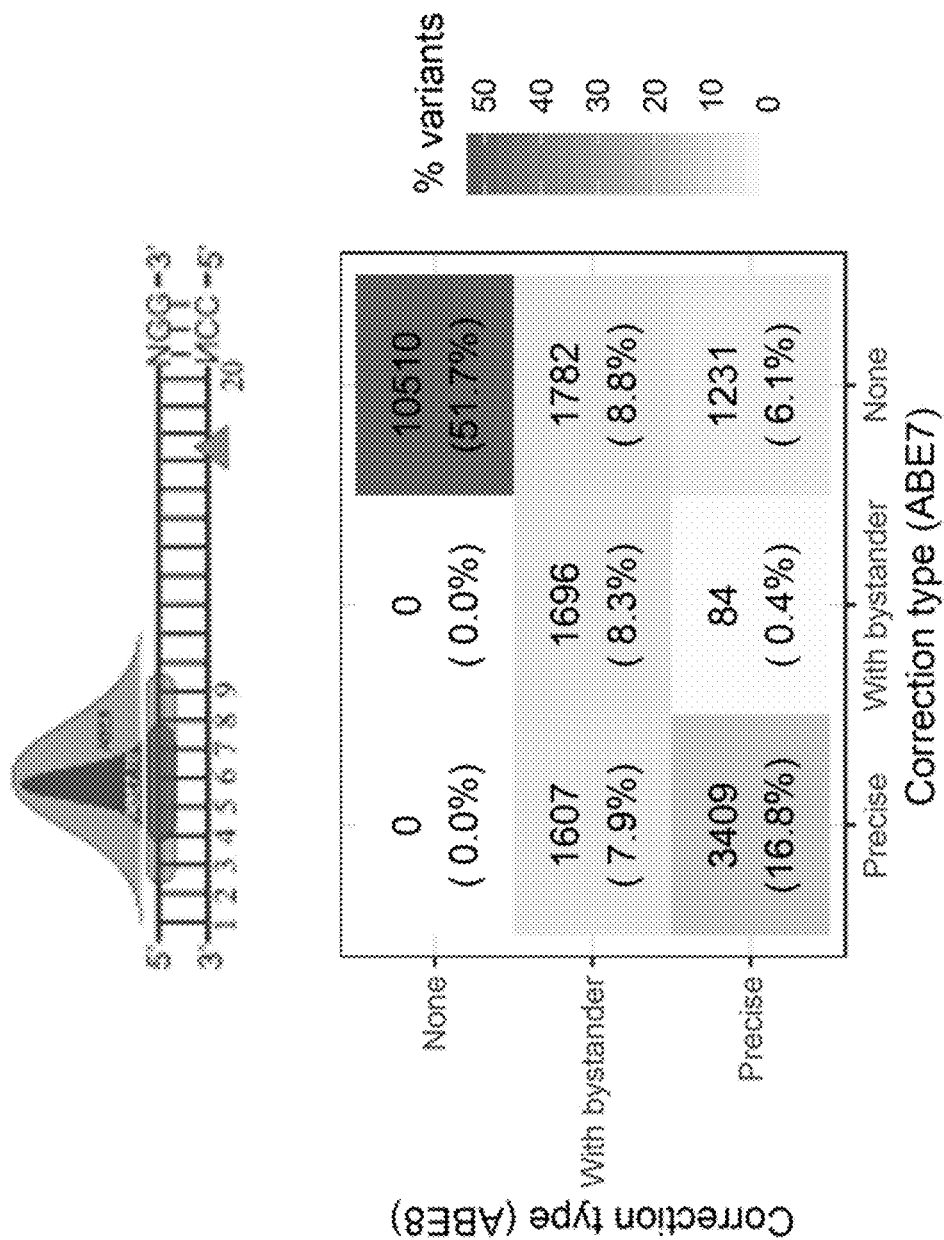

At NGG-PAM sites, ABE8s result in about 1.5× higher editing at canonical positions (A5-A7) in the protospacer and about 3.2× higher editing at non-canonical positions (A3-A4, A8-A10) compared with ABE7.10 (FIG. 13). ABE8 editing with non-NGG PAM variants resulted in about a 4.2-fold overall on-target editing than ABE7.10. The sequence of the target, the position of the "A" within the target window, and the sequence identity of the ABE8 construct itself are all factors that can impact the editing efficiency (FIG. 7E, FIGS. 11A and 11B, FIG. 13). Overall, the median change in editing across all positions, in all sites tested is 1.94-fold relative to ABE7.10 (range 1.34-4.49). The increased activity of ABE8s across the editing window enables reversion of an additional ~3000 more disease-associated mutations identified in the ClinVar database (FIG. 54C).

Figure 14:
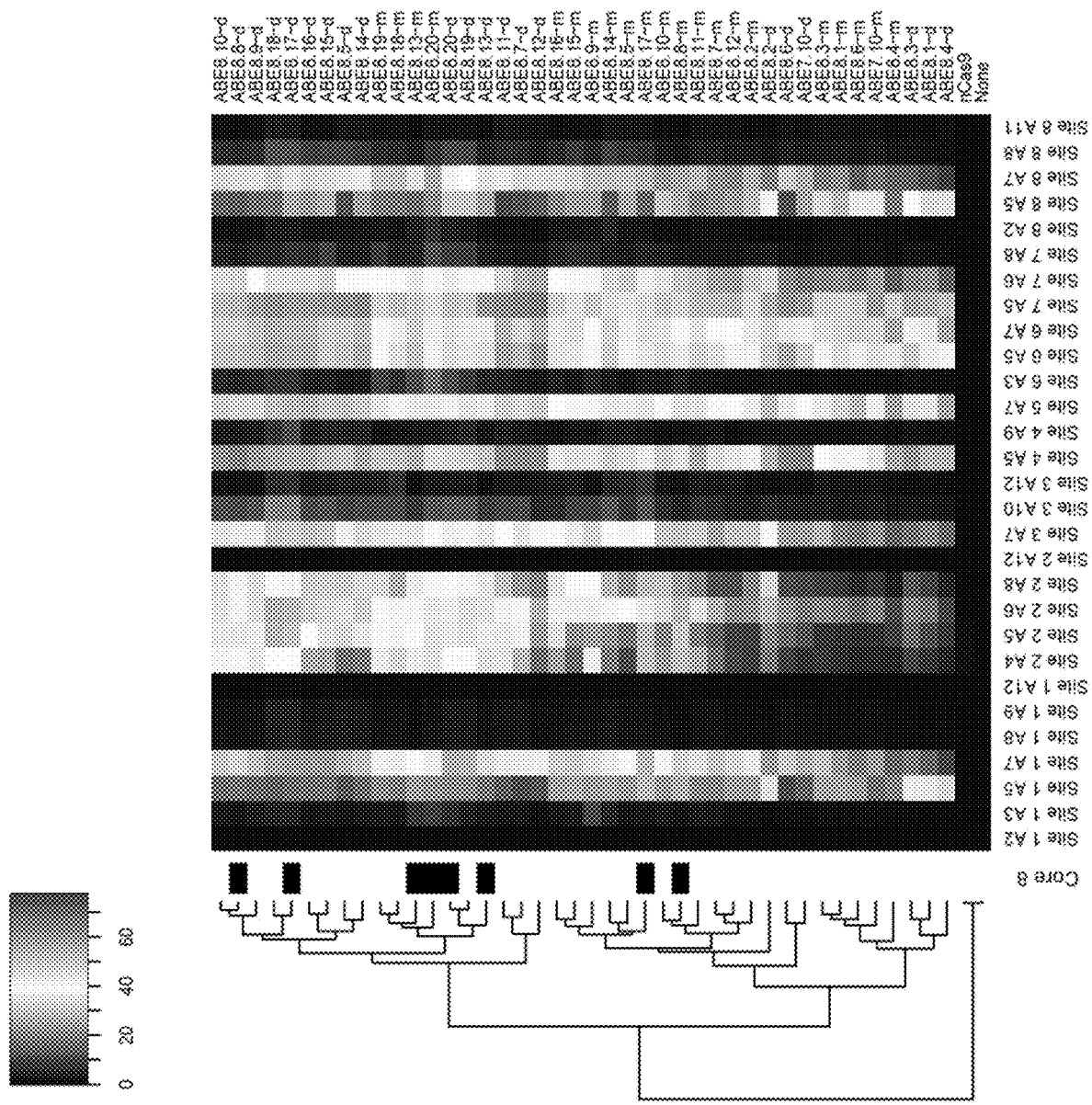
FIG. 14 depicts a dendrogram of ABE8s. Core ABE8 constructs selected for further studies highlighted.
Figure 15A:
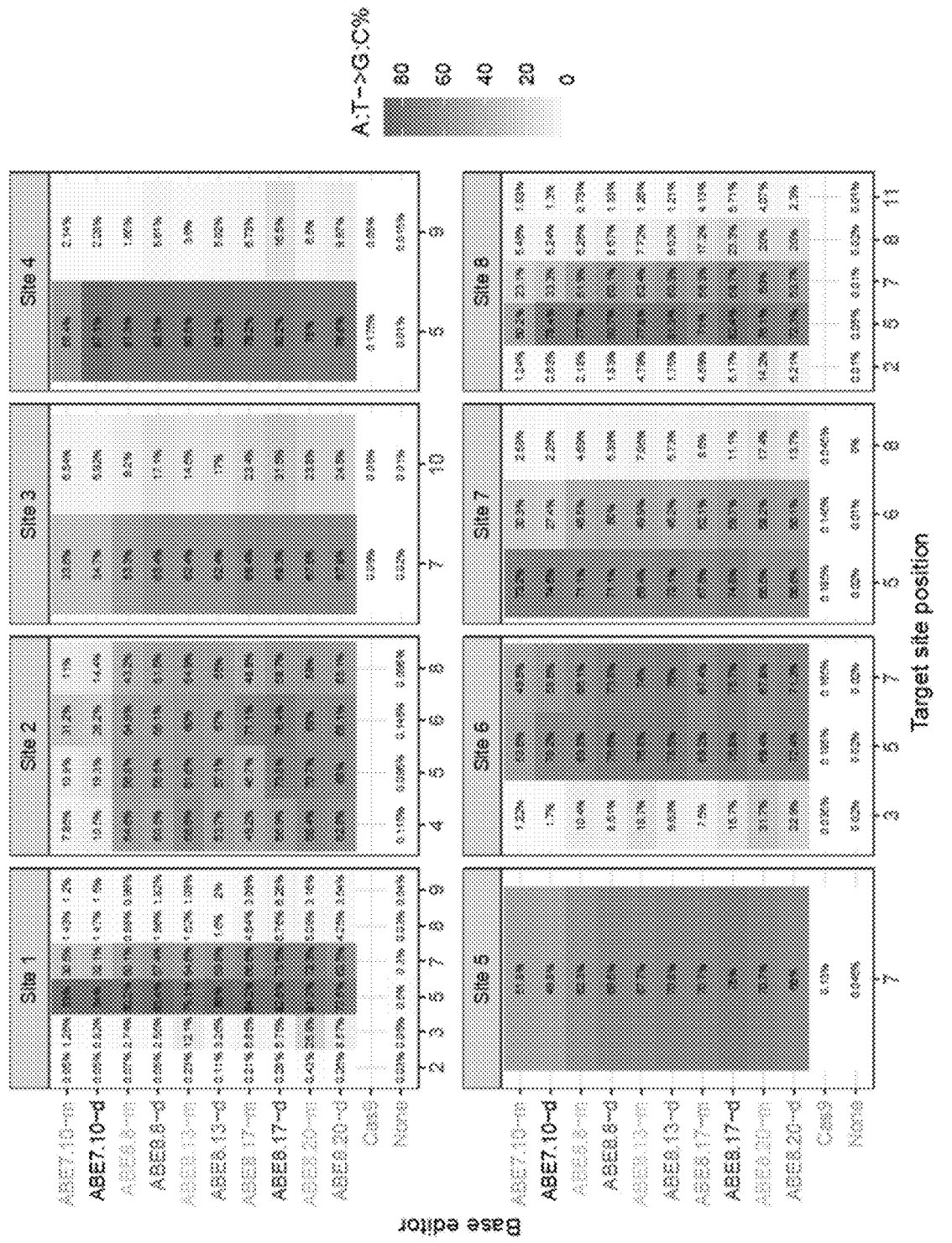
FIGS. 15A and 15B are heat maps depicting median A•T to G•C conversion of core eight ABE8 constructs in HEK293T cells across 8 genomic sites. Median values were determined from n=3 or greater biological replicates.
Figure 15B:
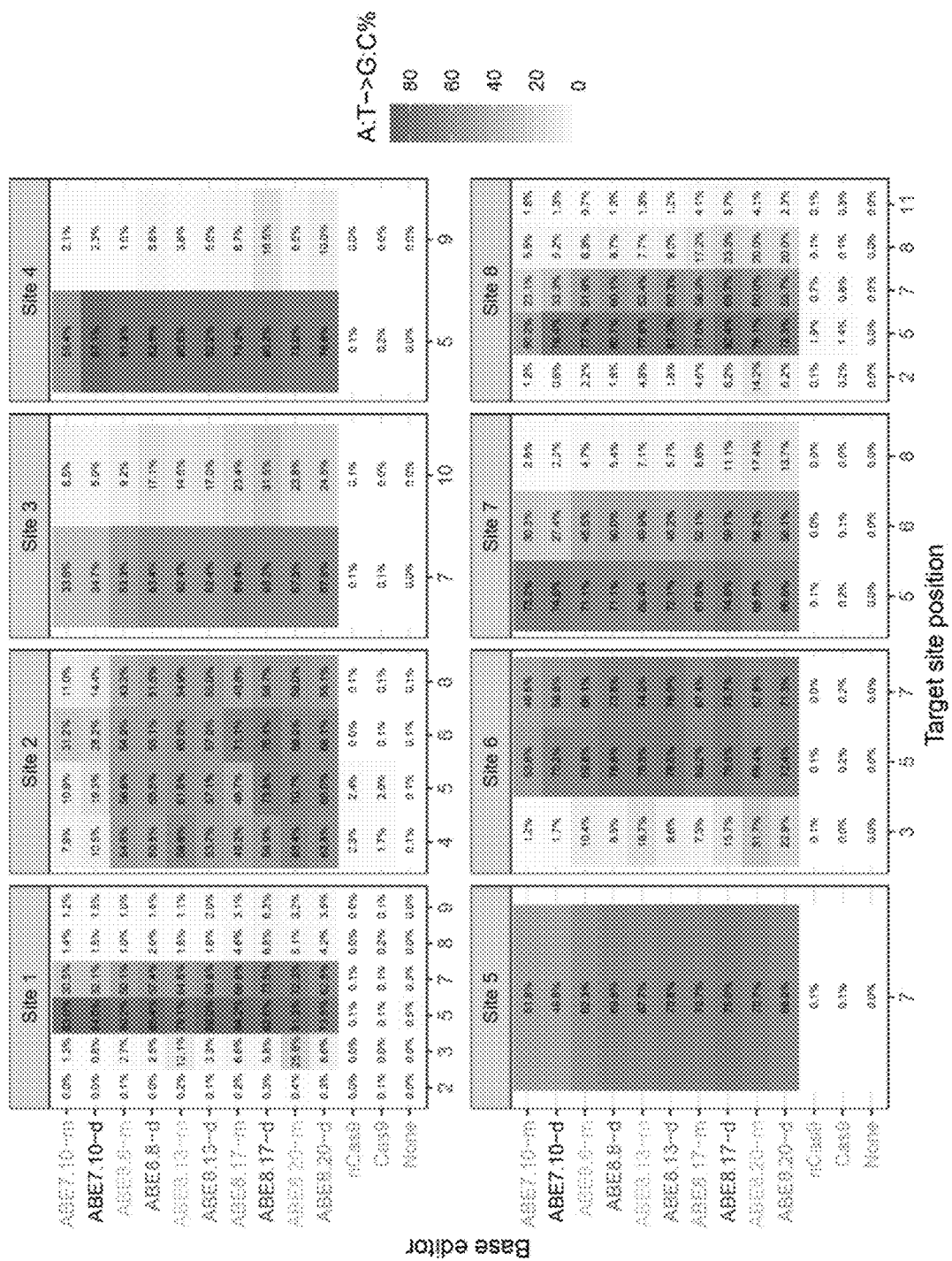
Figure 16A:
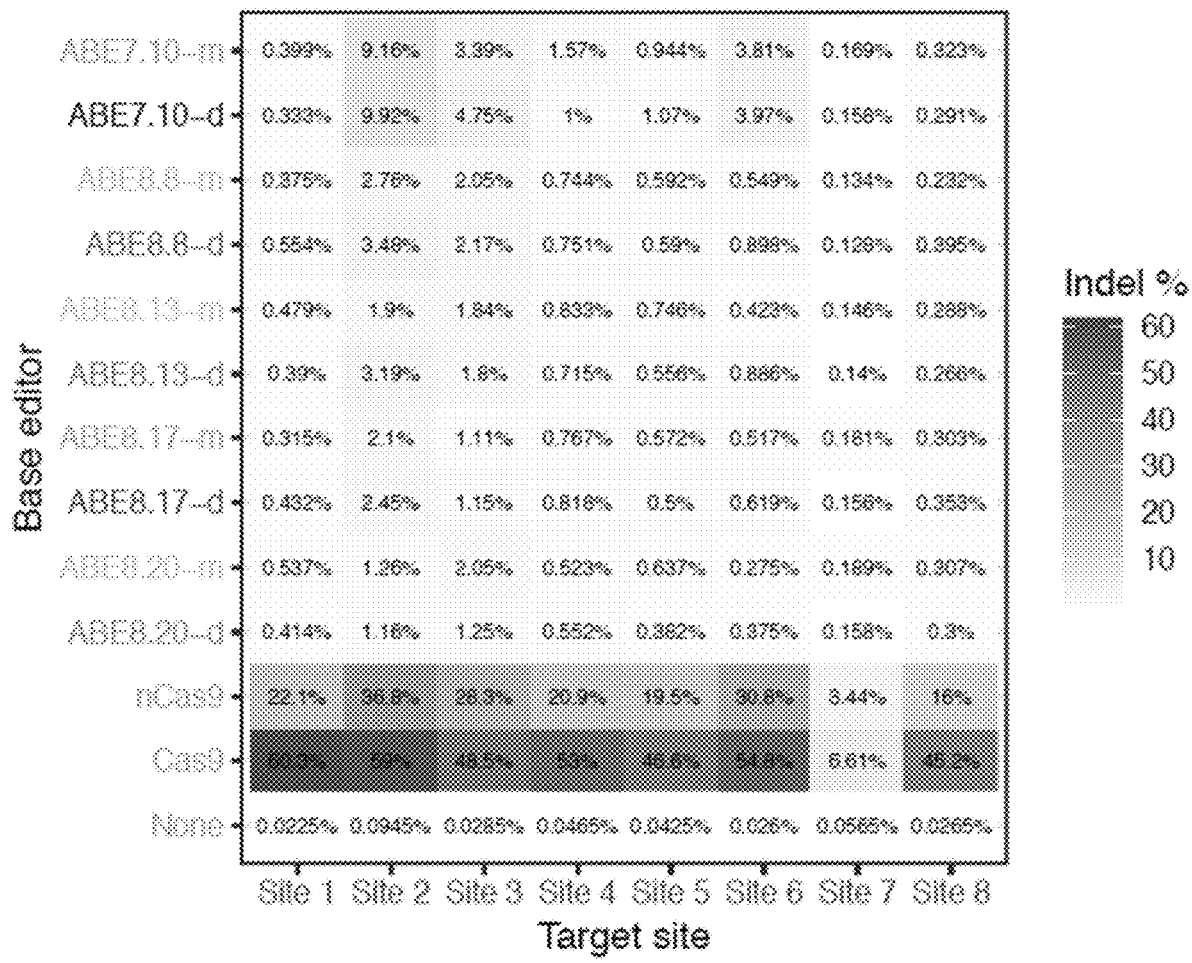
FIGS. 16A and 16B is a heat map depicting median INDEL frequency of core 8 ABE8s tested at 8 genomic sites in HEK293T cells.
Figure 16B:
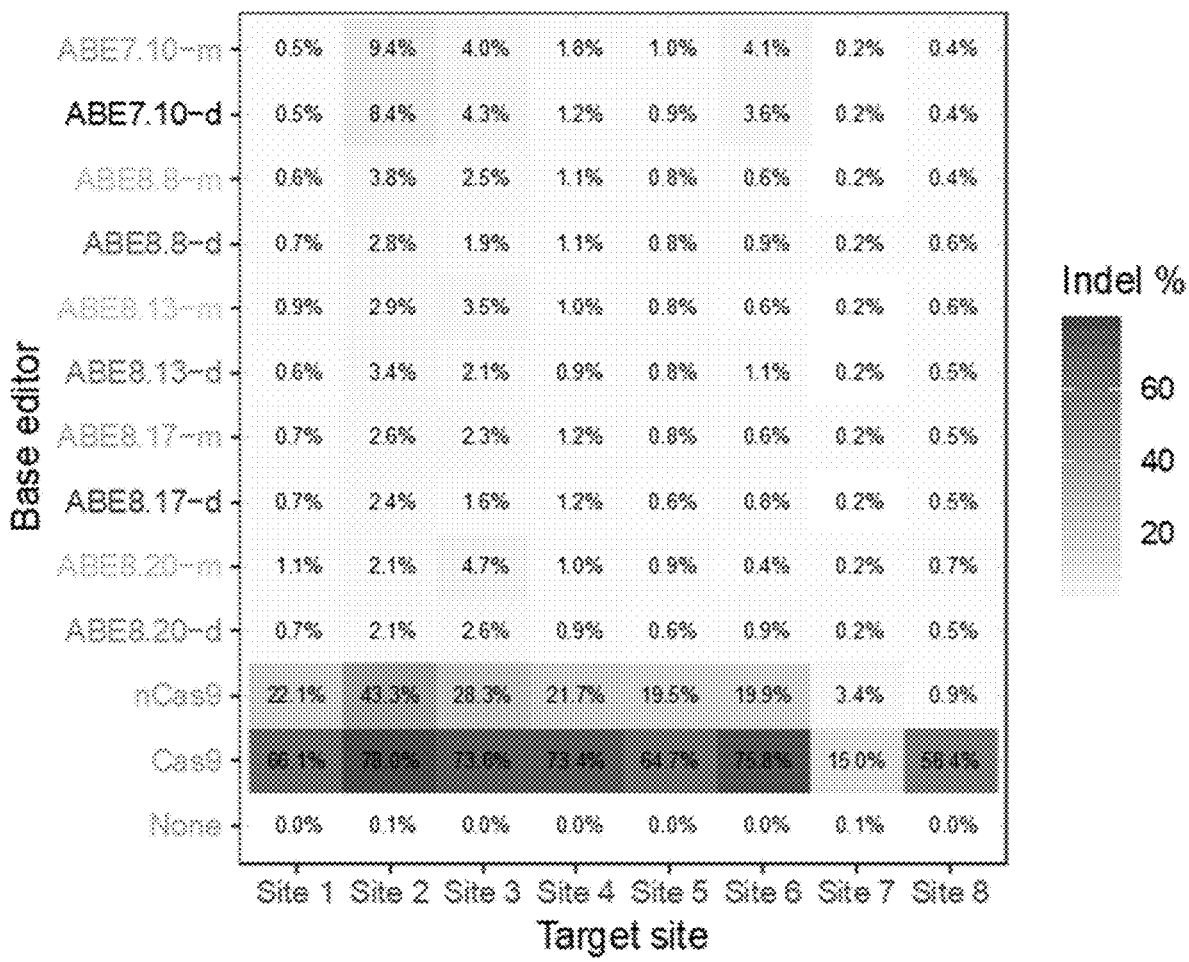
Figure 17A:
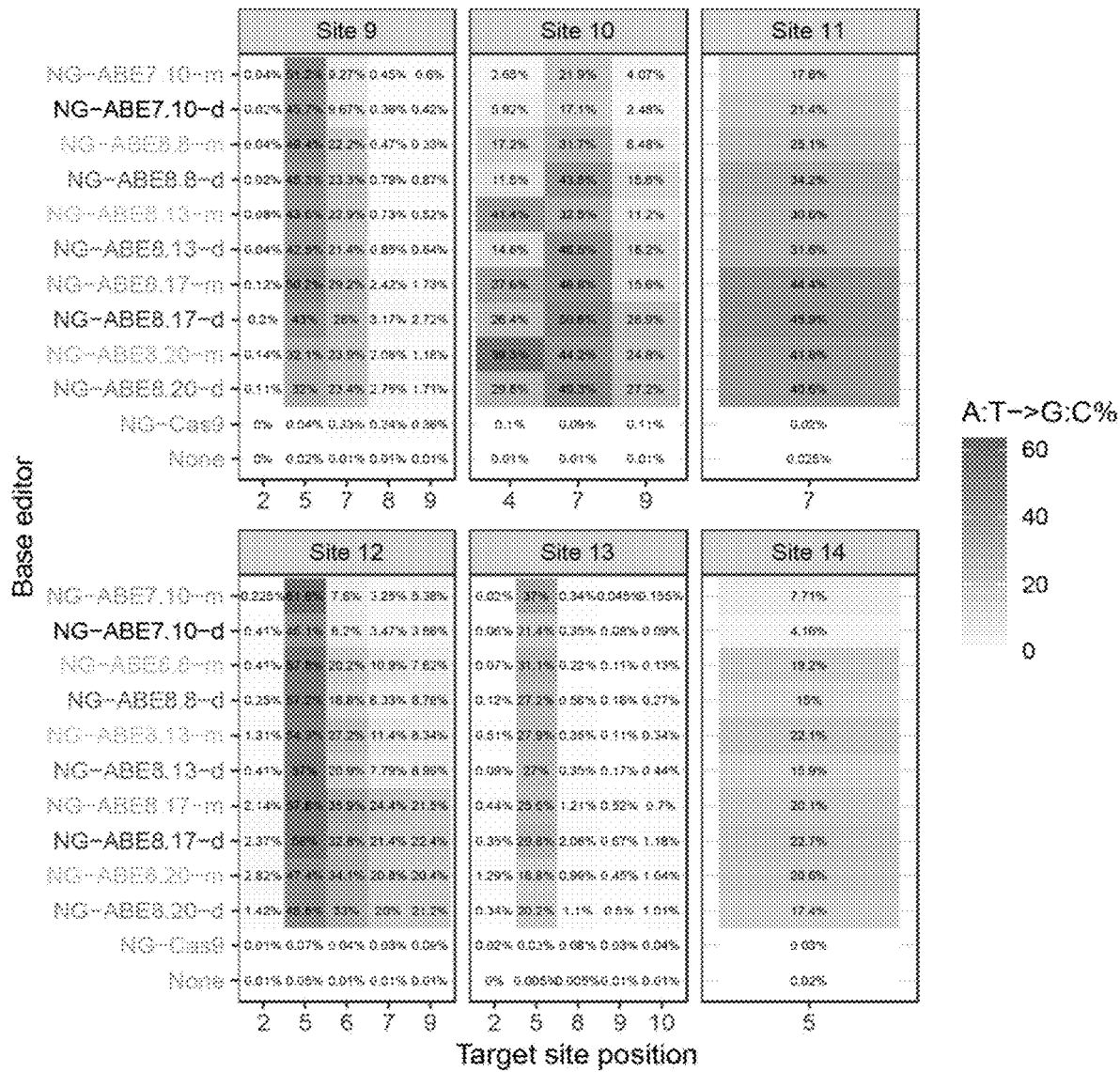
FIGS. 17A and 17B are heat maps depicting median A•T to G•C conversion of core NG-ABE8 constructs (-NG PAM) at six genomic sites in HEK293T cells. Median value generated from n=3 biological replicates.
Figure 17B:
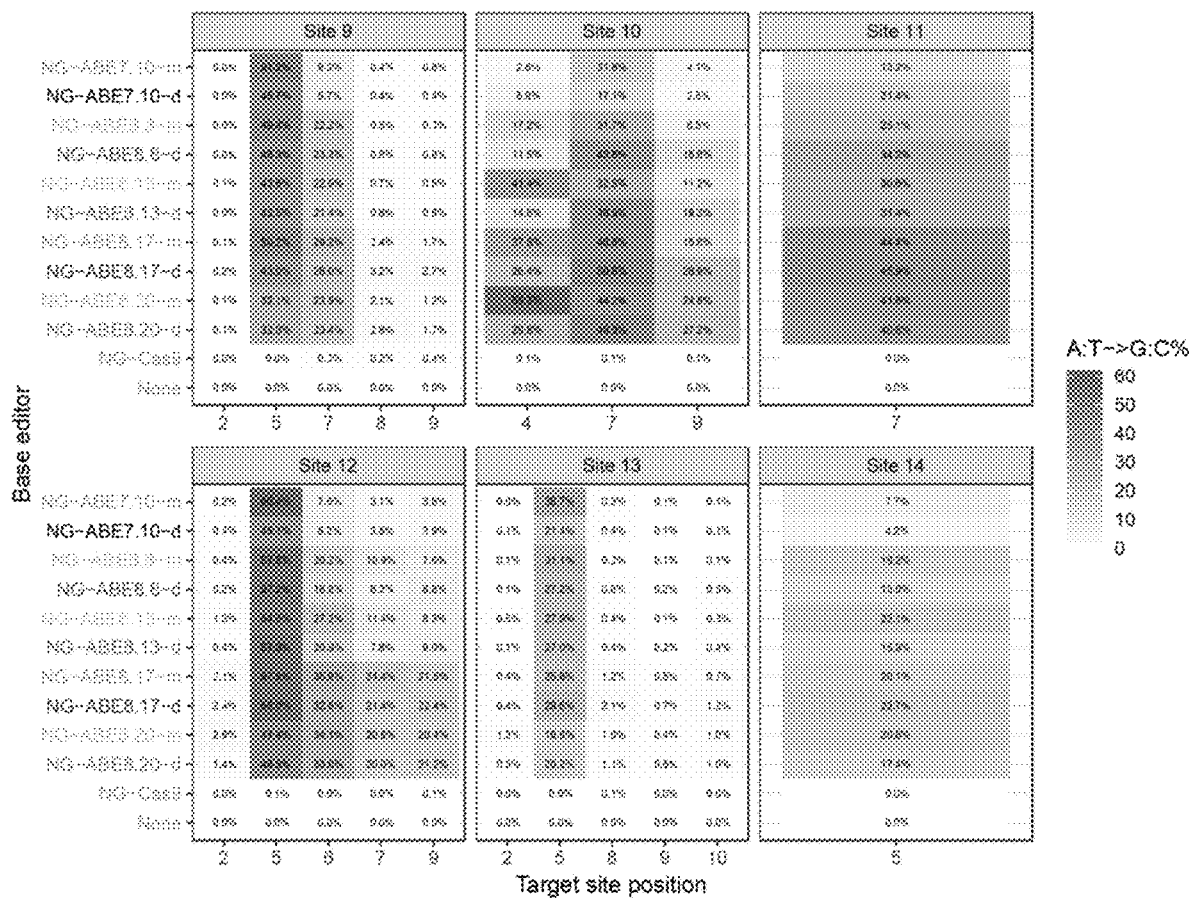
Figure 18A:
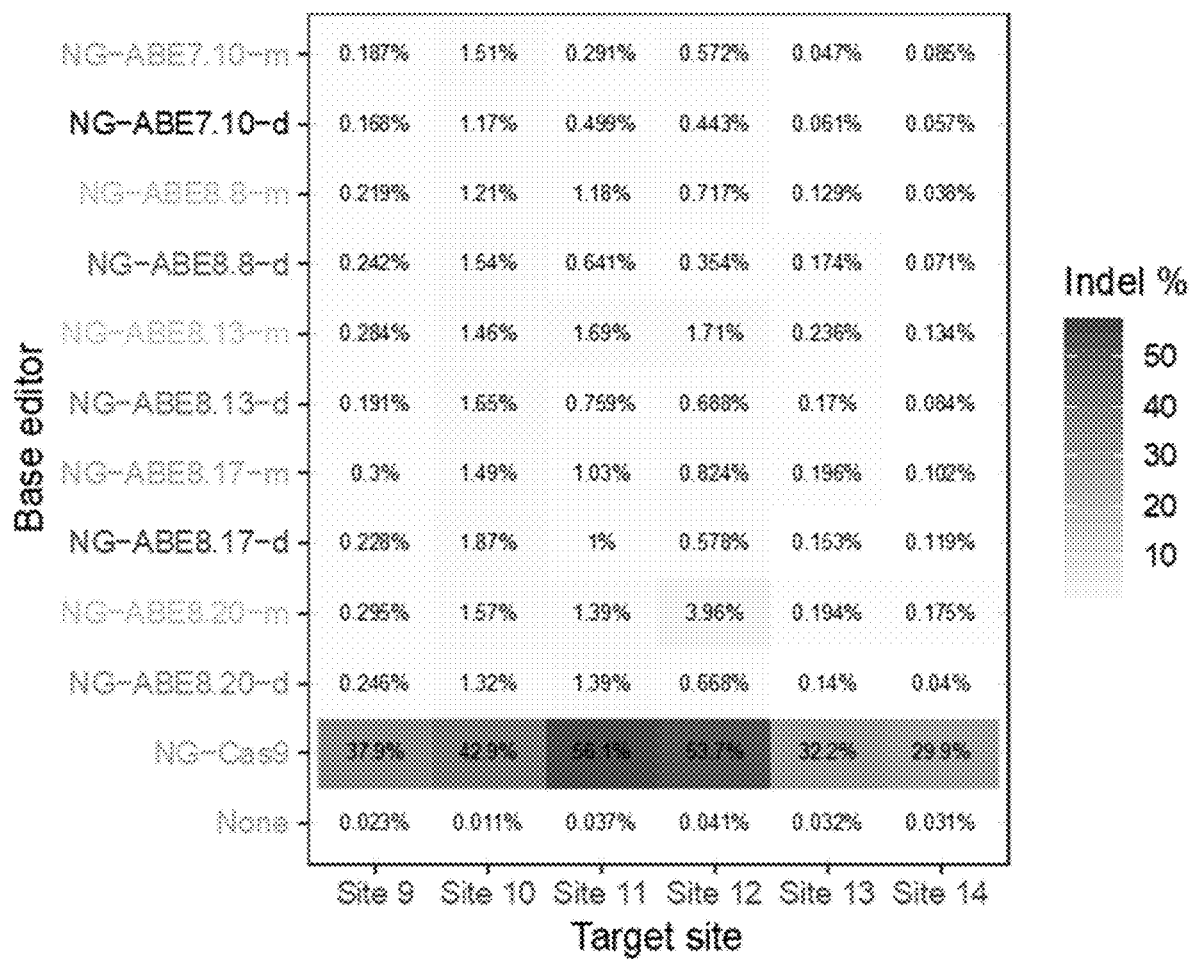
FIGS. 18A and 18B are heat maps depicting median INDEL frequency of core NG-ABE8s tested at six genomic sites in HEK293T cells. Median value generated from n=3 biological replicate.
Figure 18B:
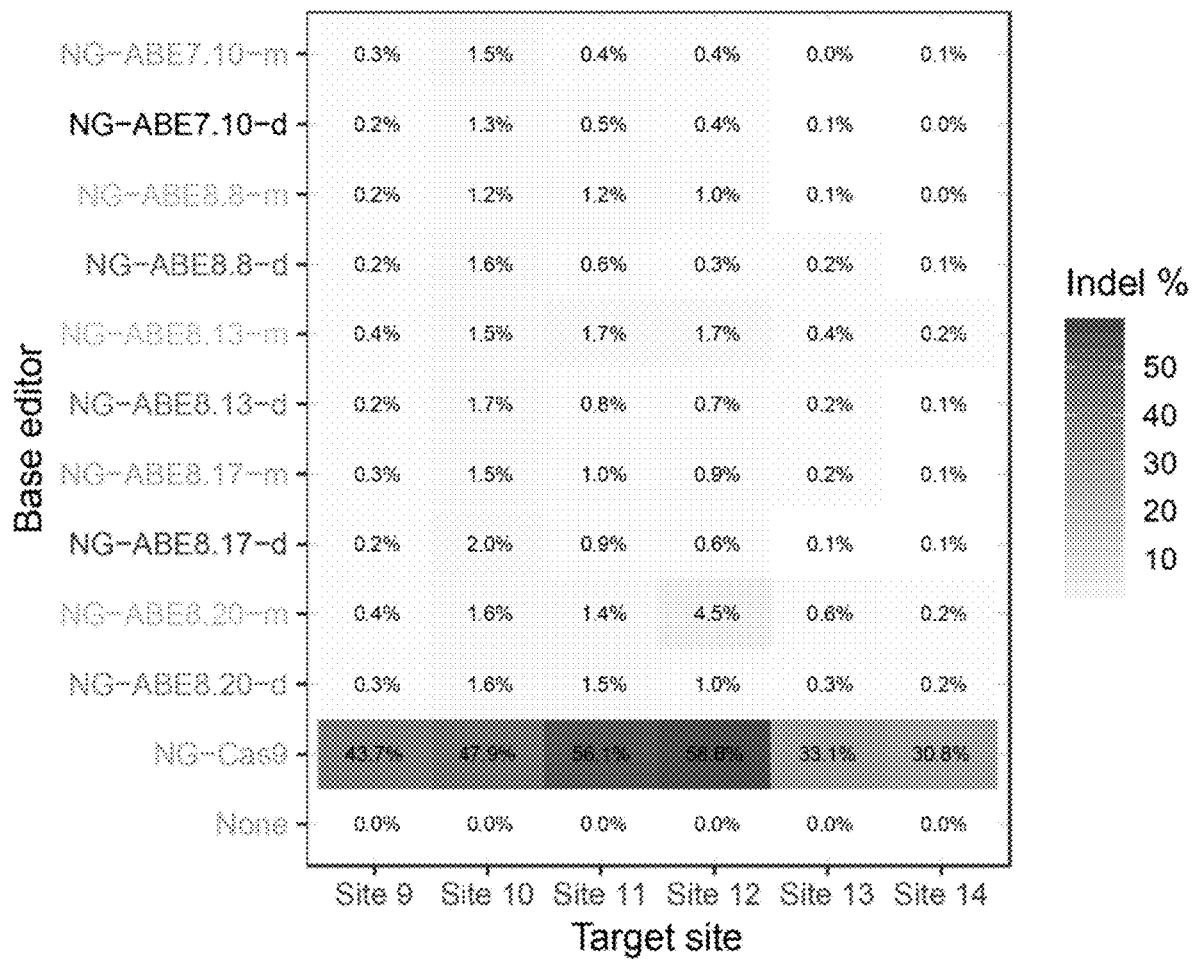
Figure 20A:
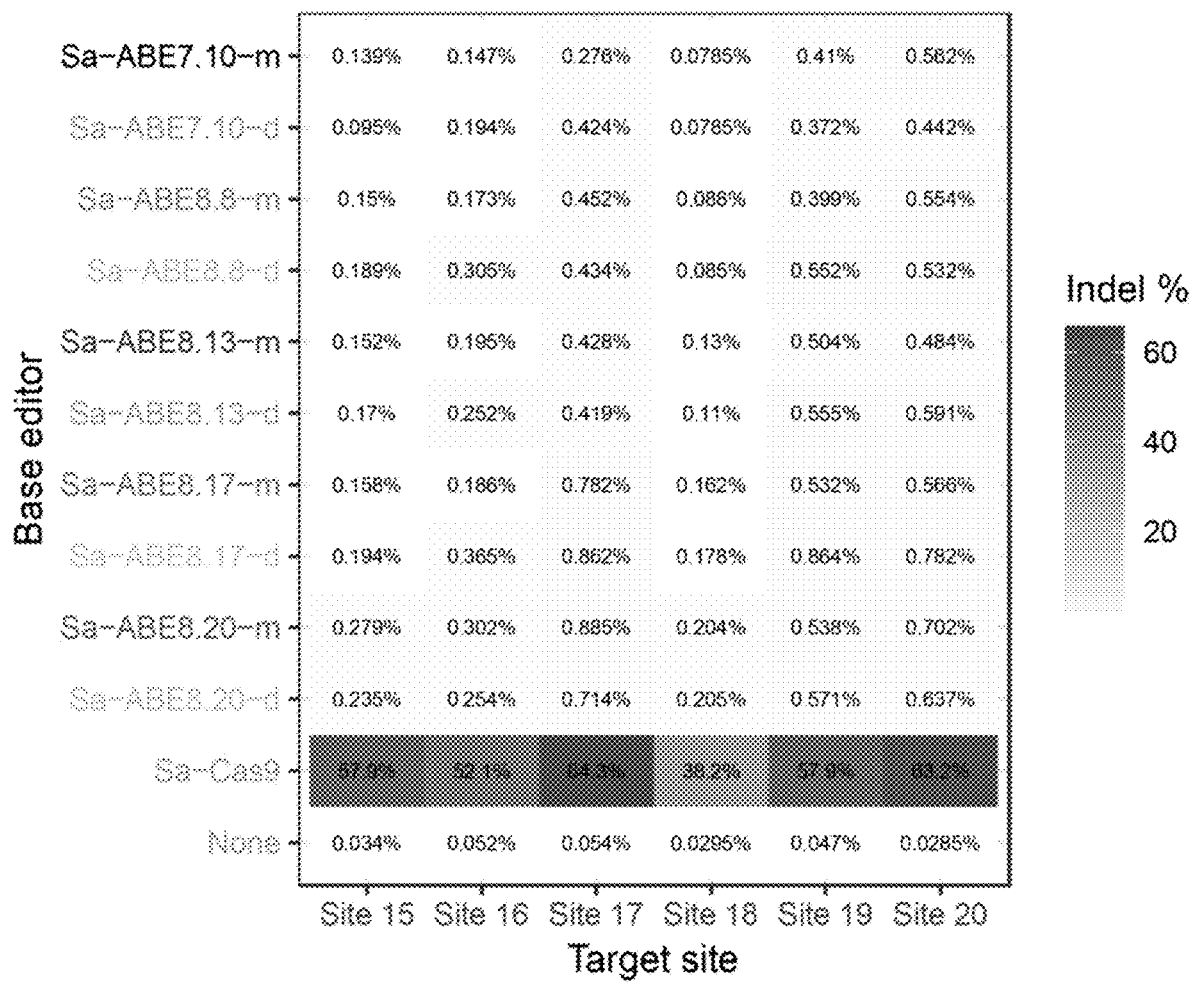
FIGS. 20A and 20B are heat maps depicting median INDEL frequency of core Sa-ABE8s tested at 8 genomic sites in HEK293T cells. Median value generated from n=3 biological replicates.
Figure 20B:
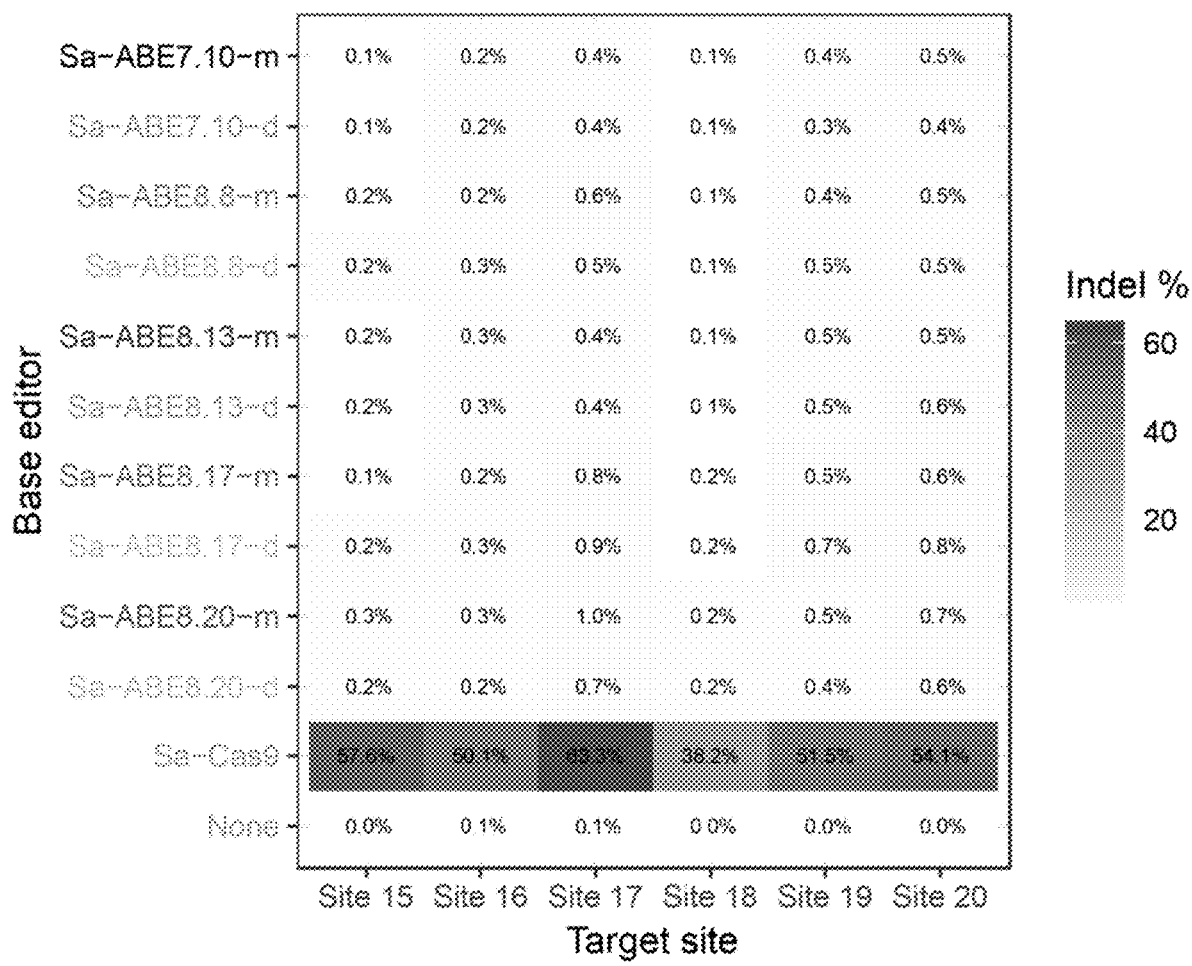
Figure 21A:
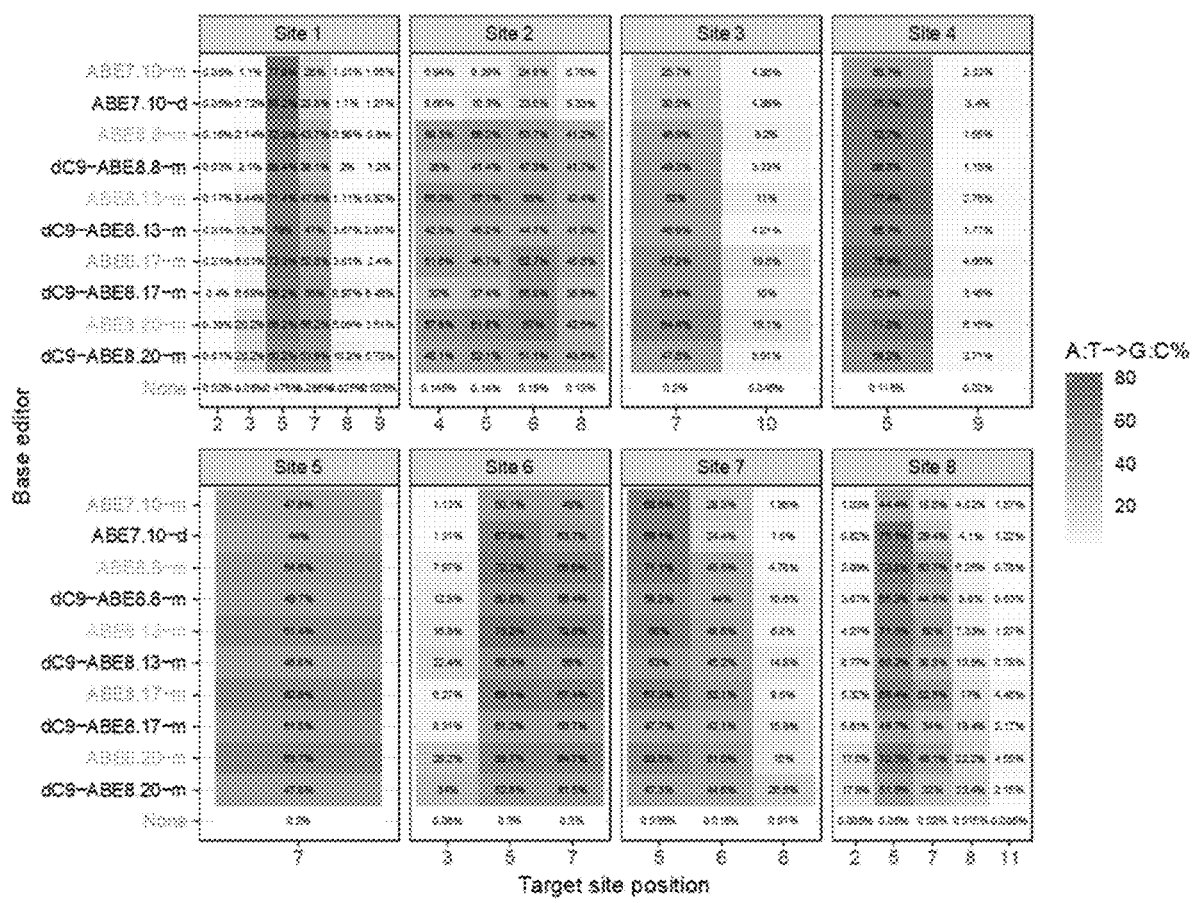
FIGS. 21A and 21B are heat maps depicting median A•T to G•C conversion of core dC9-ABE8-m constructs at eight genomic sites in HEK293T cells. Dead Cas9 (dC9) is defined as D10A and H840A mutations within S. pyogenes Cas9. Median values generated from n≥3 biological replicates.
Figure 21B:
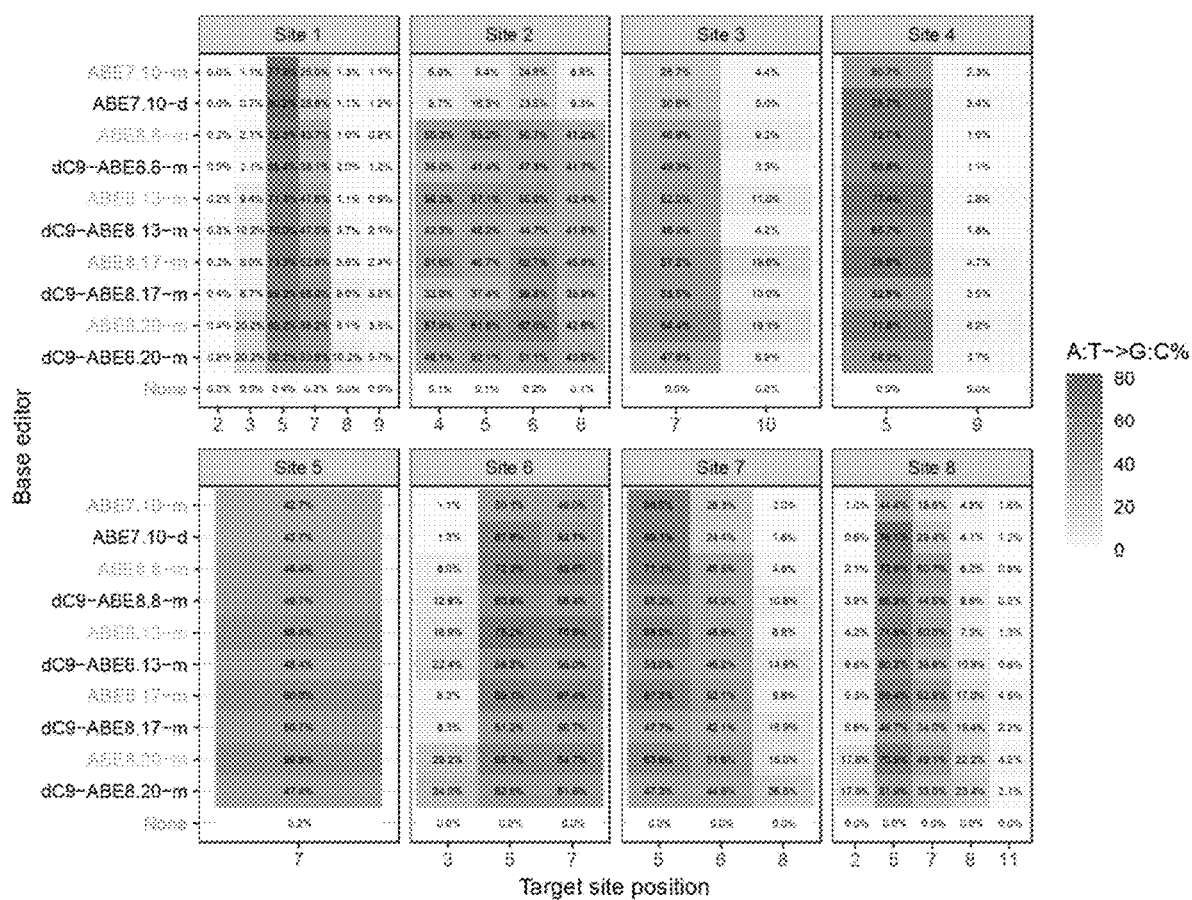
Figure 22A:
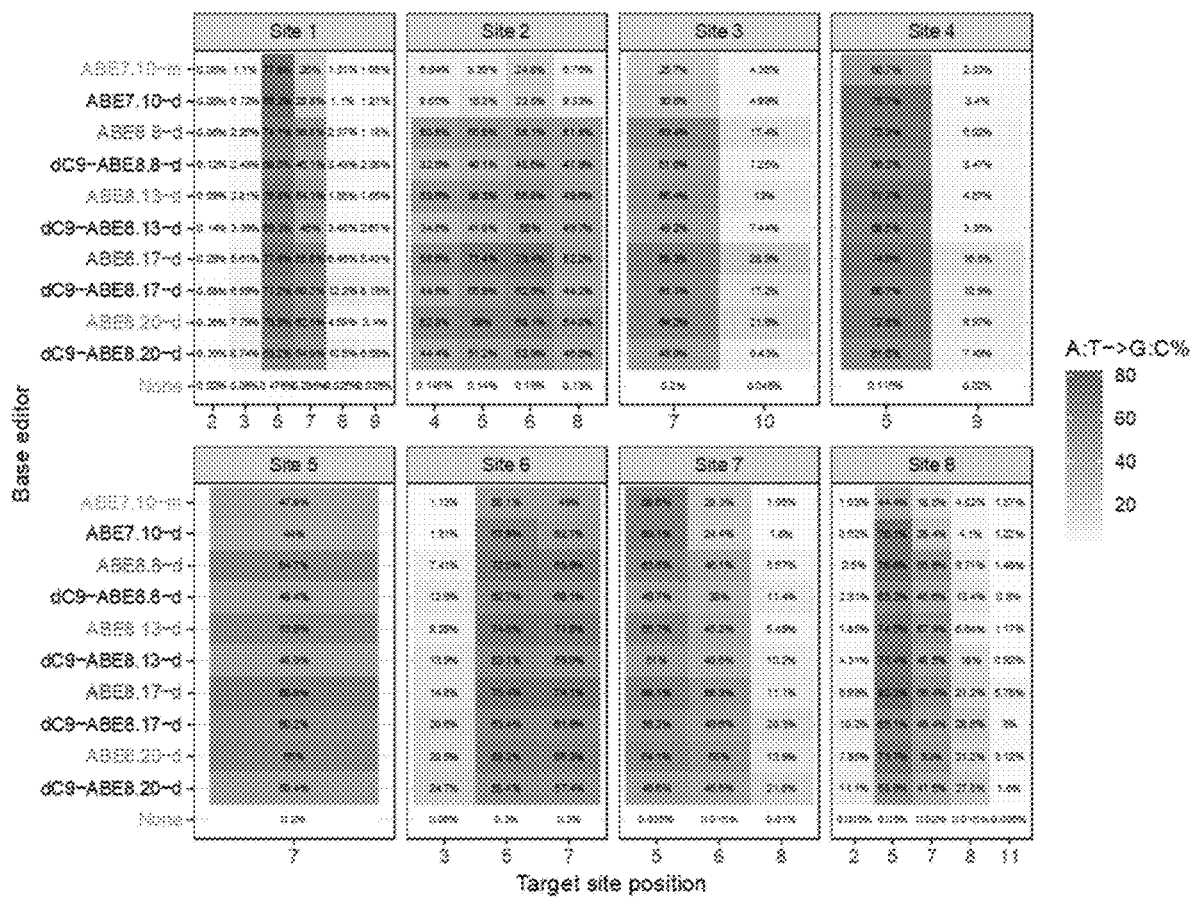
FIGS. 22A and 22B are heat maps depicting median A•T to G•C conversion of core dC9-ABE8-d constructs at eight genomic sites in HEK293T cells. Dead Cas9 (dC9) is defined as D10A and H840A mutations within S. pyogenes Cas9. Median value generated from n≥3 biological replicates.
Figure 22B:
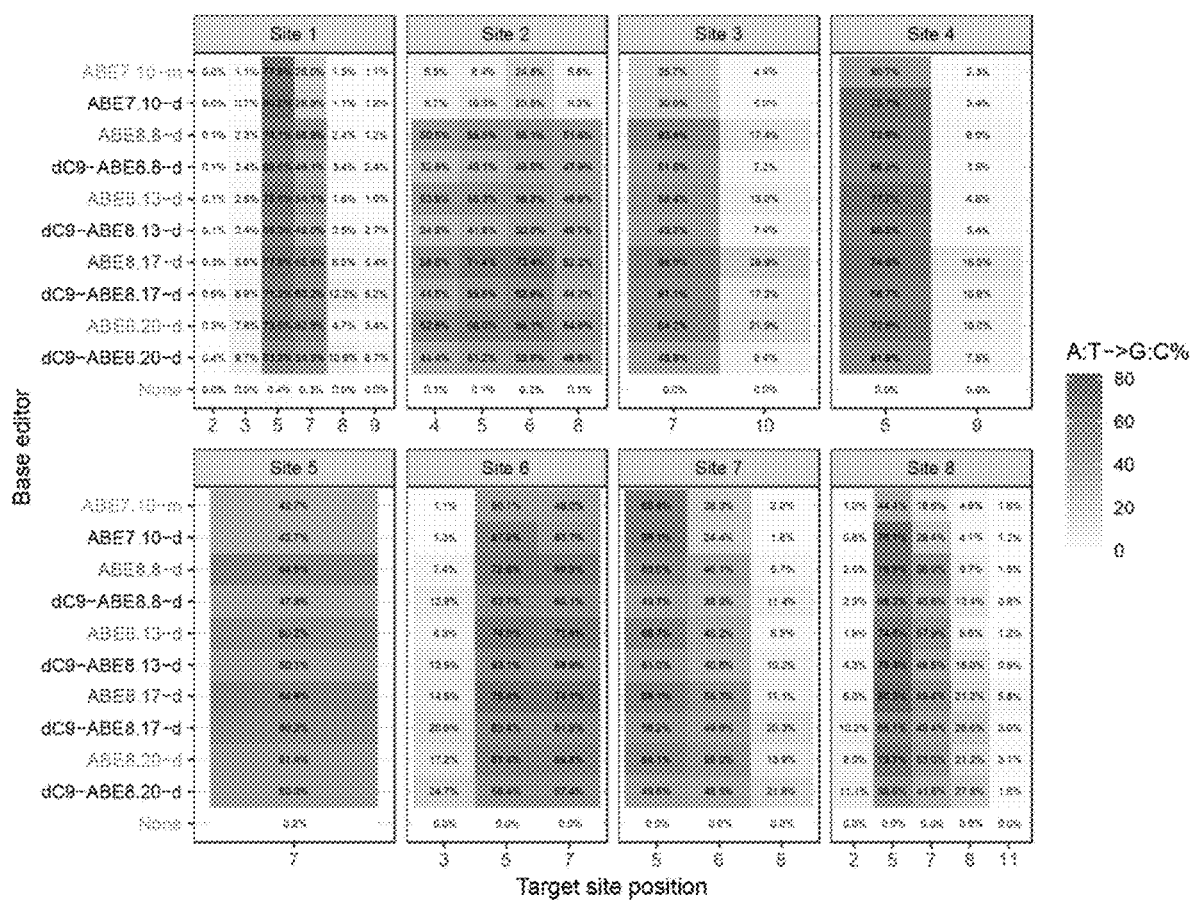
Figure 23A:
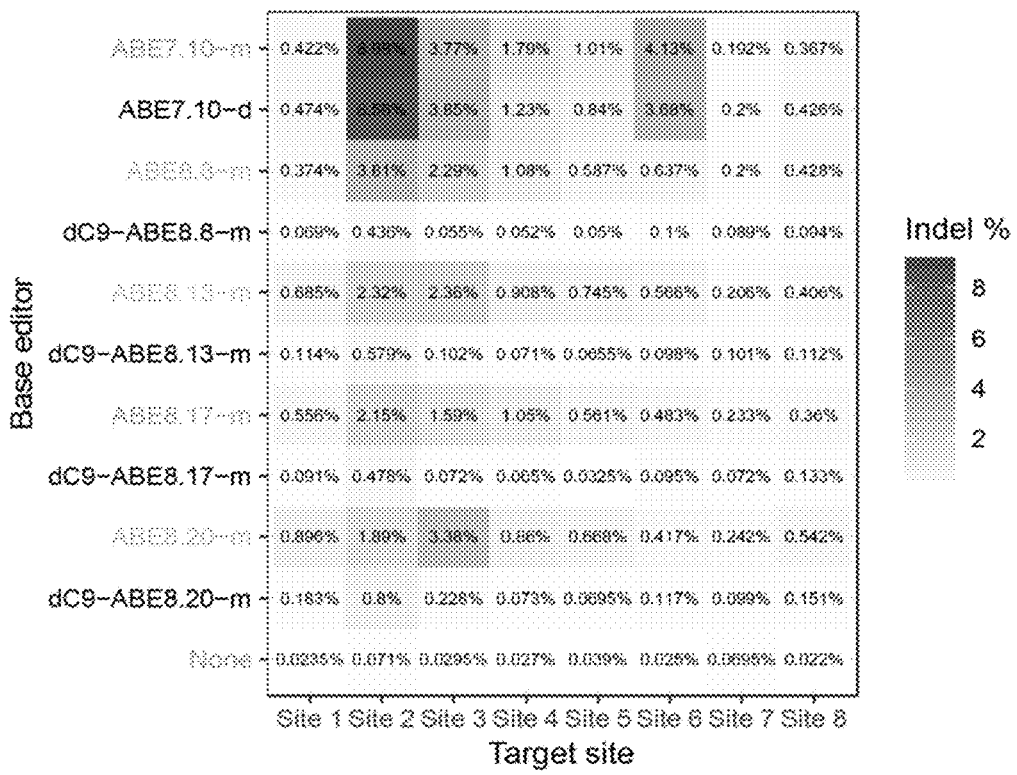
FIGS. 23A-23D depict Median INDEL frequency of core dC9-ABE8s tested at 8 genomic sites in HEK293T cells. Median values are generated from n≥3 biological replicates.
Figure 23B:
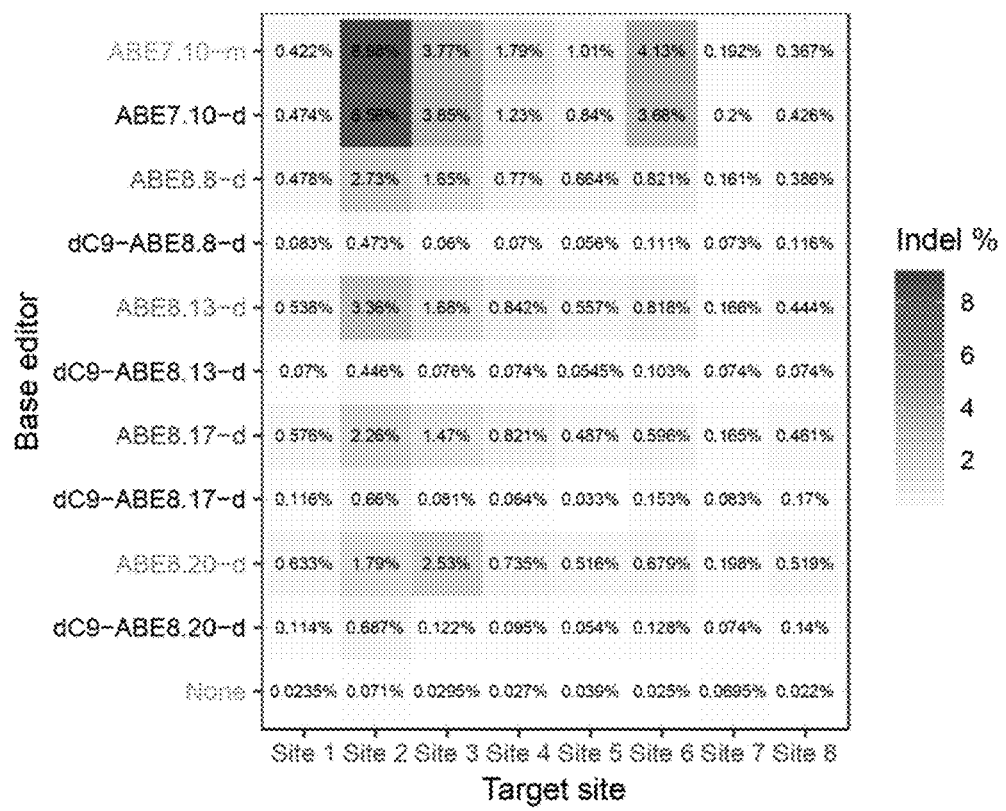
Figure 23C:
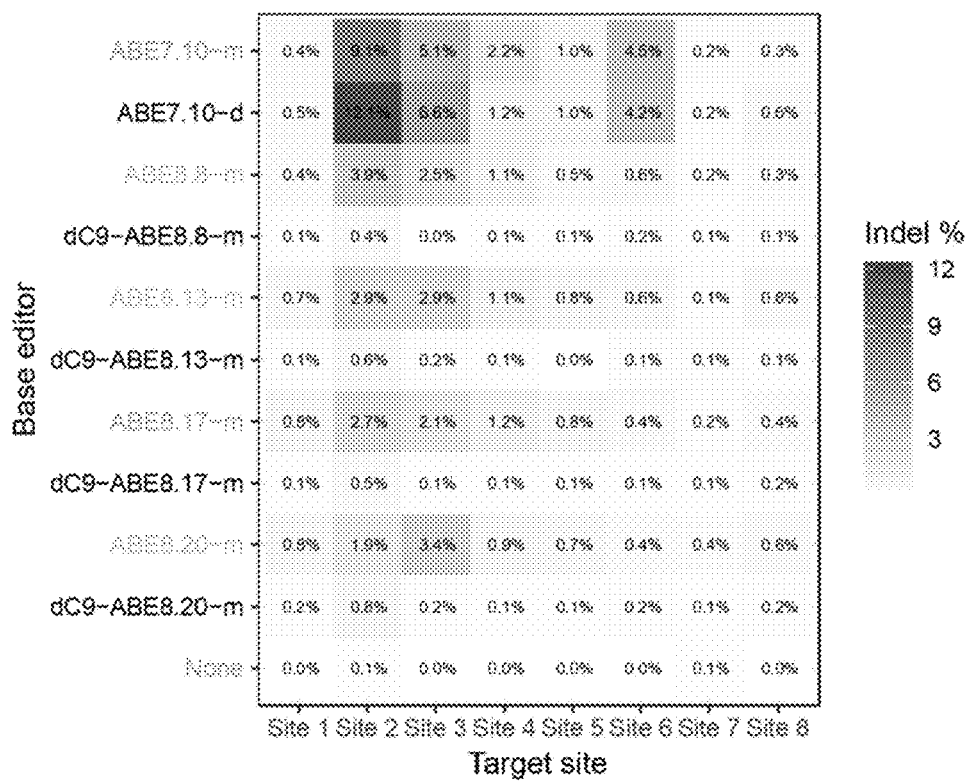
Figure 23D:
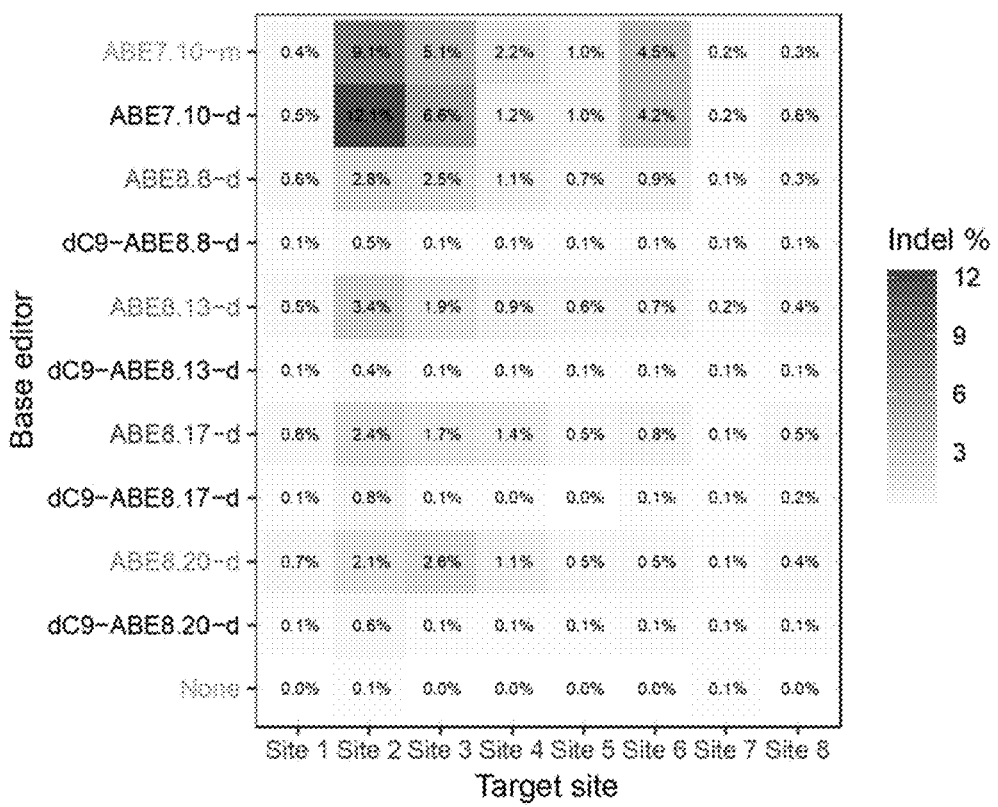

Next, from the large ABE8 pool of forty (40) constructs, a sub-set of ABE8 constructs (ABE8.8-m, ABE8.13-m, ABE8.17-m, ABE8.20-m, ABE8.8-d, ABE8.13-m, ABE8.17-d and ABE8.20-d) were selected to evaluate in greater detail. These constructs represent ABE8s with distinct differences in editing performance amongst the 8 genomic sites as determined through a hierarchical clustering analysis (FIG. 14). These ABE8s outperform ABE7.10 at all genomic sites tested (P-value=0.0006871, two-tailed Wilcoxon rank sum test) and encompass a variety of combinations of mutations identified from the ABE8 directed evolution campaign (FIGS. 15A and 15B, and FIGS. 16A and 16B).

Although ABE variants recognizing non-NGG PAMs have been described, editing efficiencies of these constructs are decreased in many instances when compared to outcomes observed with *S. pyogenes* Cas9 targeting NGG PAM sequences (see e.g., Huang, T. P. et al. Circularly permuted and PAM-modified Cas9 variants broaden the targeting scope of base editors. Nat Biotechnol 37, 626-631, doi: 10.1038/s41587-019-0134-y (2019); Hua, K. et al., Expanding the base editing scope in rice by using Cas9 variants. Plant Biotechnol J, doi:10.1111/pbi.12993 (2018); Yang, L. et al., Increasing targeting scope of adenosine base editors in mouse and rat embryos through fusion of TadA deaminase with Cas9 variants. Protein Cell 9, 814-819, doi:10.1007/s13238-018-0568-x (2018)). To determine whether evolved deaminase also increases the editing efficiencies at target sites bearing non-NGG PAMs, ABE8 editors were created that replace S. pyogenes Cas9 with an engineered S. py. variant, NG-Cas9 (PAM: NG) (Nishimasu, H. et al. Engineered CRISPR-Cas9 nuclease with expanded targeting space. Science (2018)) or Staphylococcus aureus Cas9 (Sa-Cas9, PAM: NNGRRT) (Ran, F. A. et al. In vivo genome editing using Staphylococcus aureus Cas9. Nature 520, 186-191, doi:10.1038/nature14299 (2015)). Median increases were observed in A•T to G•C editing frequencies of 1.6- and 2.0-fold, respectively, when comparing ABE8 variants to ABE7.10 for both SpCas9-NG (NG-ABE8.x-m/d) and SaCas9 (Sa-ABE8.x-m/d) (FIGS. 8A, 8B, and FIGS. 17-20). Similar to SpCas9-ABE8, the greatest differences in editing efficiencies between ABE7.10 and ABE8 constructs for the non-NGG PAM variants are observed at target A positions located at the periphery of the preferred position in the editing window (S. pyogenes: positions 4-8; S. aureus: positions 6-13; see also Rees, H. A. & Liu, D. R., Base editing: precision chemistry on the genome and transcriptome of living cells. Nat Rev Genet 19, 770-788, doi: 10.1038/s41576-018-0059-1 (2018)). ABE8 orthologs utilizing non-NGG PAMs broaden the targeting scope for efficient A base editing.

For applications where minimizing indel formation is necessary, the effect of replacing the catalytically impaired D10A nickase mutant of Cas9 with a catalytically "dead" version of Cas9 (D10A+H840A) (see Jinek, M. et al. A programmable dual-RNA-guided DNA endonuclease in adaptive bacterial immunity. Science 337, 816-821, doi: 10.1126/science.1225829 (2012)) was explored in the core eight ABE8 constructs ("dC9-ABE8.x-m/d"). By replacing the nickase with dead Cas9 in ABEs, a >90% reduction in indel frequency was observed for dC9-ABE8 variants relative to ABE7.10 while maintaining a higher (2.1-fold), on-target DNA editing efficiency (FIGS. 8C, 21A and 21B, 22A and 22B, 23A-23D). Although indels above background are observed, frequencies ranged from 0.3-0.8% at sites tested. dC9-ABE8 variants had a median 14% reduction in on-target DNA editing efficiencies relative to canonical ABE8s.

Figure 24:
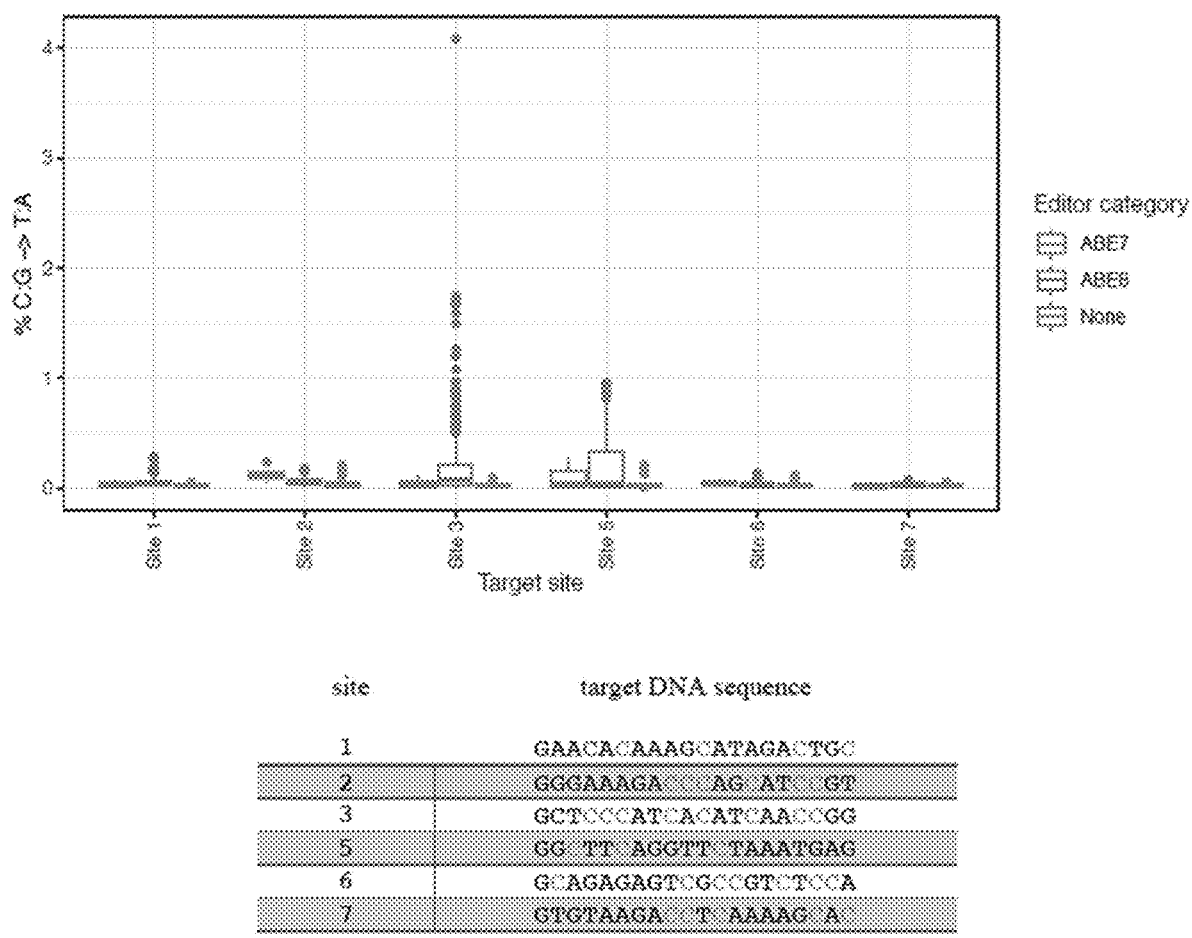
FIG. 24 depicts C•G to T•A editing with Hek293T cells treated with ABE8s and ABE7.10.

Another class of undesired ABE-mediated genome edits at an on-target locus can be an ABE-dependent cytosine to uracil (C•G to T•A) conversion (see Grunewald, J. et al., CRISPR DNA base editors with reduced RNA off-target and self-editing activities. Nat Biotechnol 37, 1041-1048, doi: 10.1038/s41587-019-0236-6 (2019); Lee, C. et al. CRISPR-Pass: Gene Rescue of Nonsense Mutations Using Adenine Base Editors. Mol Ther 27, 1364-1371, doi:10.1016/j.ymthe.2019.05.013 (2019)). At the eight target sites tested, the 95$^{th}$ percentile of C-to-T editing was measured to be 0.45% with ABE8 variants and 0.15% with ABE7.10-d or -m, indicating that on-target cytosine deamination with ABEs can occur but the frequencies are generally very low (FIG. 24). Thus, ABE8s retain high specificity for A-to-G conversion.

Example 4: DNA On-Target and sgRNA-Dependent DNA Off-Target Editing by ABE8 Constructs Improve Specificity for DNA As with all base editors, ABE8s have the potential to act at off-target loci in the genome and transcriptome (see e.g., Gaudelli, N. M. et al. Programmable base editing of A*T to G*C in genomic DNA without DNA cleavage. Nature 551, 464-471, doi:10.1038/nature24644 (2017); Komor, A. C., et al., Programmable editing of a target base in genomic DNA without double-stranded DNA cleavage. Nature 533, 420-424, doi:10.1038/nature17946 (2016); Grunewald, J. et al. CRISPR DNA base editors with reduced RNA off-target and self-editing activities. Nat Biotechnol 37, 1041-1048, doi: 10.1038/s41587-019-0236-6 (2019); Rees, H. A., et al., Analysis and minimization of cellular RNA editing by DNA adenine base editors. Sci Adv 5, eaax5717, doi:10.1126/sciadv.aax5717 (2019); Rees, H. A. et al. Improving the DNA specificity and applicability of base editing through protein engineering and protein delivery. Nat Commun 8, 15790, doi:10.1038/ncomms15790 (2017); Jin, S. et al. Cytosine, but not adenine, base editors induce genome-wide off-target mutations in rice. Science 364, 292-295, doi: 10.1126/science.aaw7166 (2019); Zuo, E. et al. Cytosine base editor generates substantial off-target single-nucleotide variants in mouse embryos. Science 364, 289-292, doi: 10.1126/science.aav9973 (2019); Lee, H. K., et al., Cytosine but not adenine base editor generates mutations in mice. Biorxiv, doi:https://doi.org/10.1101/731927 (2019); Grunewald, J. et al. Transcriptome-wide off-target RNA editing induced by CRISPR-guided DNA base editors. Nature 569, 433-437, doi:10.1038/s41586-019-1161-z (2019); Zhou, C. et al. Off-target RNA mutation induced by DNA base editing and its elimination by mutagenesis. Nature 571, 275-278, doi:10.1038/s41586-019-1314-0 (2019)).

Figure 25A:
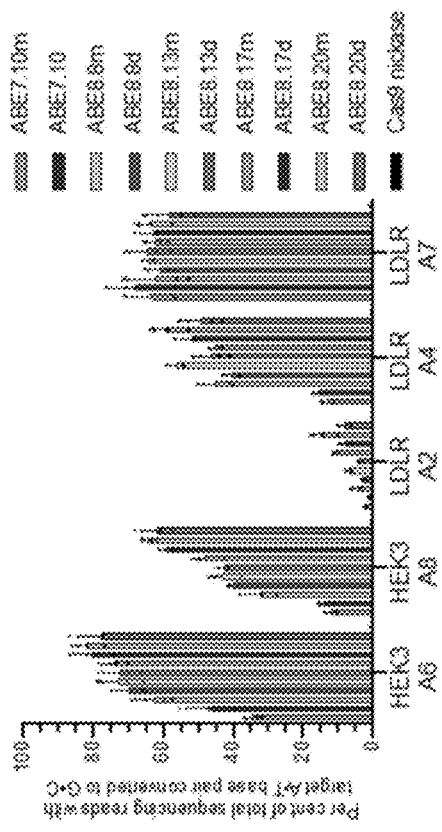
Figure 25C:
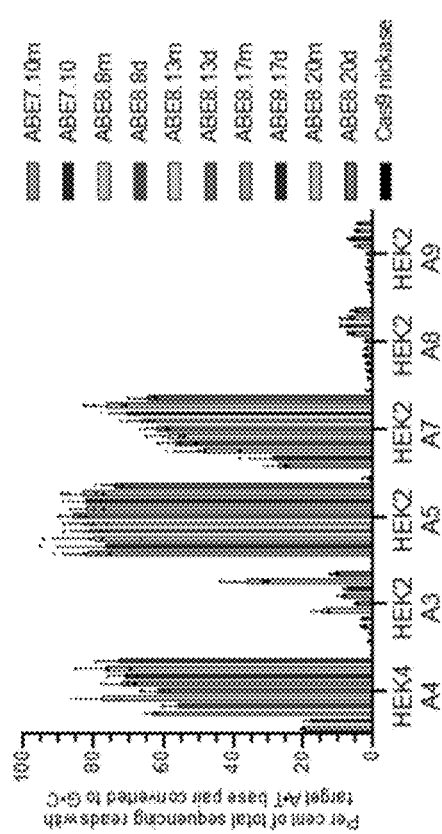
Figure 25B:
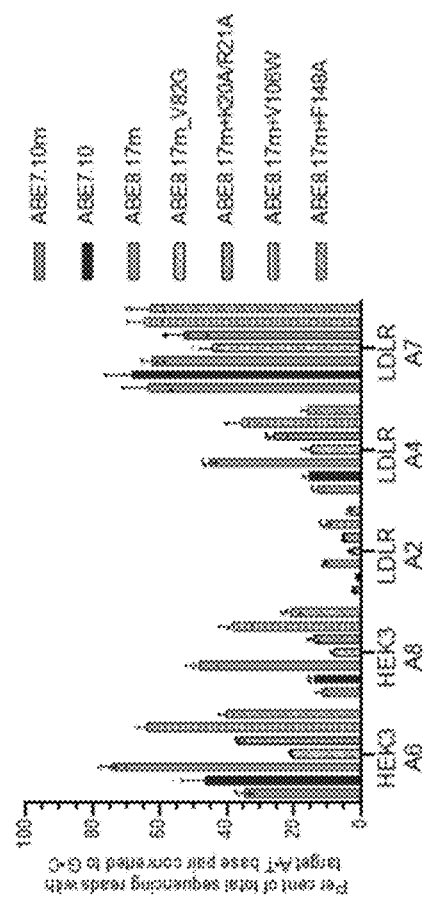
Figure 25D:
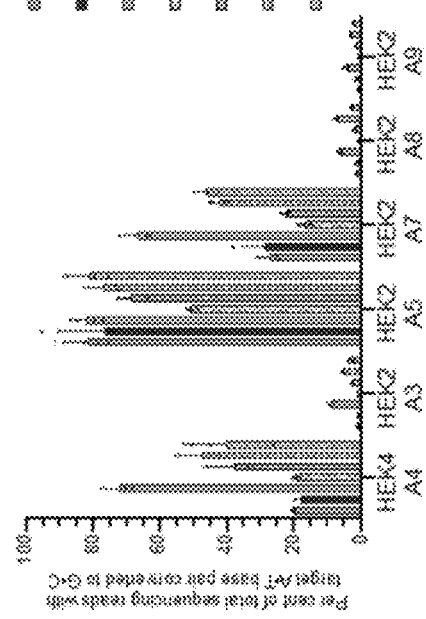
Figure 26:
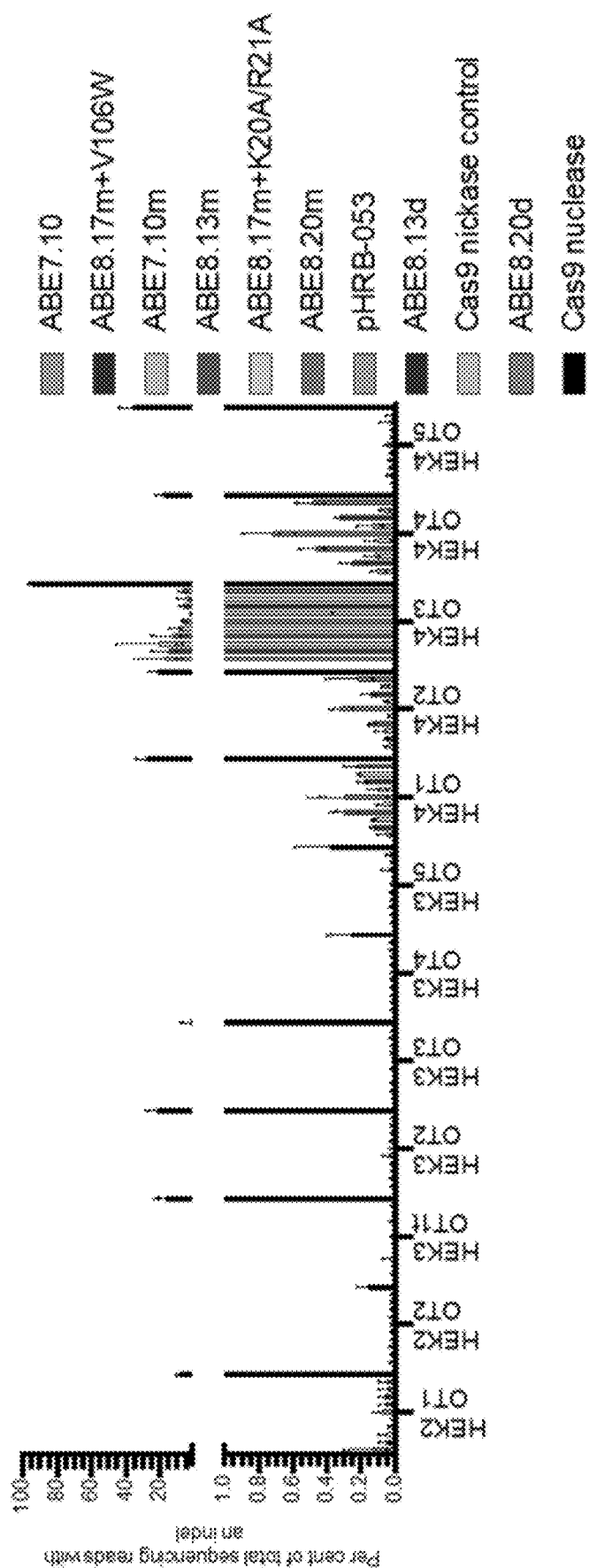
FIG. 26 is a graph depicting indel frequencies at 12 previously identified sgRNA-dependent Cas9 off-target loci in human cells Individual data points are shown and error bars represent s.d. for n=3 independent biological replicates, performed on different days.

Base editing at four on-target (FIGS. 25A and 25B) and twelve previously identified sgRNA-associated off-target loci in genomic DNA (Tsai, S. Q. et al. GUIDE-seq enables genome-wide profiling of off-target cleavage by CRISPR-Cas nucleases. Nat Biotechnol 33, 187-197, doi:10.1038/nbt.3117 (2015)) (FIGS. 25E and 25F) were measured, all of which were confirmed to be true Cas9 off-target loci in HEK293T cells (FIG. 26). As expected from their increased activity at on-target loci, ABE8 constructs exhibit 3-6-fold greater DNA off-target editing frequencies than ABE7.10. Whilst this is a caveat for use of ABE8 constructs, careful choice and analysis of the sgRNA can substantially decrease sgRNA-dependent off-target editing (see Tsai, S. Q. et al. GUIDE-seq enables genome-wide profiling of off-target cleavage by CRISPR-Cas nucleases. Nat Biotechnol 33, 187-197, doi:10.1038/nbt.3117 (2015); Yeh, W. H., et al., In vivo base editing of post-mitotic sensory cells. Nat Commun 9, 2184, doi:10.1038/s41467-018-04580-3 (2018)). For applications requiring use of promiscuous sgRNAs, installation of the DNA- and RNA-specificity enhancing V106W mutation (Rees, H. A., Wilson, C., Doman, J. L. & Liu, D. R. Analysis and minimization of cellular RNA editing by DNA adenine base editors. Sci Adv 5, eaax5717, doi: 10.1126/sciadv.aax5717 (2019)) into the TadA domain of ABE8.17m can decrease the DNA off-target editing 2.6-fold while maintaining levels of on-target editing exceeding those of ABE7.10 (FIGS. 25C, 25D, 25G and 25H).

To measure the sgRNA-independent off-target activity of ABE8s, targeted amplification and high throughput sequencing of cellular RNAs was performed in HEK293T cells treated with ABEs (see Gaudelli, N. M. et al. Programmable base editing of A*T to G*C in genomic DNA without DNA cleavage. Nature 551, 464-471, doi:10.1038/nature24644 (2017); Rees, H. A., et al., Analysis and minimization of cellular RNA editing by DNA adenine base editors. Sci Adv 5, eaax5717, doi:10.1126/sciadv.aax5717 (2019)). In this assay, ABE8s displayed between 2.3-5.3-fold greater mean frequencies of cellular RNA adenosine deamination as compared to ABE7.10 (FIG. 25A).

Off-target deamination effects of ABE8s were assessed by integrating previously published mutations (Grunewald, J. et al. CRISPR DNA base editors with reduced RNA off-target and self-editing activities. Nat Biotechnol 37, 1041-1048, doi:10.1038/s41587-019-0236-6 (2019); Rees, H. A., et al., Analysis and minimization of cellular RNA editing by DNA adenine base editors. Sci Adv 5, eaax5717, doi:10.1126/sciadv.aax5717 (2019); Grunewald, J. et al. Transcriptome-wide off-target RNA editing induced by CRISPR-guided DNA base editors. Nature 569, 433-437, doi:10.1038/s41586-019-1161-z (2019); Zhou, C. et al. Off-target RNA mutation induced by DNA base editing and its elimination by mutagenesis. Nature 571, 275-278, doi:10.1038/s41586-019-1314-0 (2019)), designed to mitigate spurious cellular RNA deamination for ABE7.10, into ABE8s. These mutations were integrated into the TadA portion of the deaminase enzyme of ABE8.17-m. All of the installed RNA off-targeting mutations decreased the on-target editing frequencies of ABE8.17-m to differing extents, with V106W and F148A impairing ABE8 the least (FIGS. 25C and 25D). Of these, only V106W was able to substantially reduce the level of off-target RNA and DNA editing (FIG. 25B). Thus, the inclusion of the V106W mutation to ABE8 can enable high on-target editing efficiency with reduced DNA- and RNA-off-target deamination events and is applicable where transient perturbation of the cellular transcriptome must be avoided, or for use with promiscuous sgRNAs.

To comprehensively assess the off-target editing associated with ABE8s, on- and off-target editing was compared in ABE7 and ABE8s by targeting three on-target sites (FIGS. 55A and 55B), and twelve loci previously characterized for high sgRNA-associated Cas9 off-target activity in genomic DNA (see Tsai, S. Q. et al. GUIDE-seq enables genome-wide profiling of off-target cleavage by CRISPR-Cas nucleases. Nat Biotechnol 33, 187-197, doi:10.1038/nbt.3117 (2015); FIGS. 55C and 55D), and in HEK293T cells (FIG. 61). Although plasmid delivery of genome editing agents is widely used for base editing research purposes, mRNA delivery is more effective for editing primary human cells (Hendel, A. et al. Chemically modified guide RNAs enhance CRISPR-Cas genome editing in human primary cells. Nat Biotechnol 33, 985-989, doi:10.1038/nbt.3290 (2015)), and the delivery method for a base editor is a critical determinant of its off-target profile (Rees, H. A. et al. Improving the DNA specificity and applicability of base editing through protein engineering and protein delivery. Nat Commun 8, 15790, doi:10.1038/ncomms15790 (2017)). Therefore, impact of plasmid or mRNA delivery was tested for on- and off-target activity. The on-target efficiency of both ABE7 and ABE8s was comparable between plasmid and mRNA delivery of ABE, despite the more transient lifetime of mRNA versus plasmid over-expression. Notably, mRNA delivery of ABEs to cells resulted in increased editing efficiency (FIG. 55B) as compared with plasmid delivery (FIG. 55A), particularly when the target adenine base was in the center of the editing window (position 5 or 6).

When plasmid overexpression was used as a delivery modality for base editors, ABE8 constructs exhibited a 3- to 6-fold greater sgRNA-dependent DNA off-target editing frequencies than ABE7.10 (FIG. 55C). Remarkably, when ABEs were delivered using mRNA, the guide-dependent DNA off-target editing associated with ABE8 constructs was decreased by an average of 1.5-fold (for ABE7.10-d) and 2.2-fold (for ABE8.20-m, the most heavily modified ABE8 relative to ABE7.10-d). Notably, off-target base editing activity associated with non-repetitive sgRNAs HEK2 and HEK3 was reduced from above 14% with plasmid delivery to below 0.4% by mRNA delivery (FIGS. 55C and 55D). Thus, for therapeutic and other applications requiring high DNA editing specificity, mRNA delivery, careful choice of sgRNA (Tsai, S. Q. et al. GUIDE-seq enables genome-wide profiling of off-target cleavage by CRISPR-Cas nucleases. Nat Biotechnol 33, 187-197, doi:10.1038/nbt.3117 (2015); Yeh, W. H., et al. In vivo base editing of post-mitotic sensory cells. Nat Commun 9, 2184, doi:10.1038/s41467-018-04580-3 (2018)), and consideration of V106W inclusion in TadA to substantially reduce DNA off-target editing frequencies, are beneficial to that of the negative control for the non-repetitive sgRNAs HEK2 and HEK3 (FIG. 55E).

Next, the levels of spurious deamination of cellular mRNA associated with ABE8s was measured. To generate data on all the constructs of interest in a high-throughput manner, we began with targeted amplification and high throughput sequencing of two cellular RNAs in HEK293T cells treated with ABEs. Consistent with previous publications (Grunewald, J. et al. CRISPR DNA base editors with reduced RNA off-target and self-editing activities. Nat Biotechnol 37, 1041-1048, doi:10.1038/s41587-019-0236-6 (2019); Rees, H. A., et al. Analysis and minimization of cellular RNA editing by DNA adenine base editors. Sci Adv 5, eaax5717, doi:10.1126/sciadv.aax5717 (2019); Grunewald, J. et al. Transcriptome-wide off-target RNA editing induced by CRISPR-guided DNA base editors. Nature 569, 433-437, doi:10.1038/s41586-019-1161-z (2019); Zhou, C. et al. Off-target RNA mutation induced by DNA base editing and its elimination by mutagenesis. Nature 571, 275-278, doi:10.1038/s41586-019-1314-0 (2019)), treatment with ABE7, and, to a greater extent, ABE8 lead to detectable A-to-I deamination in cellular RNA when delivered by plasmid overexpression (FIG. 55E). However, when delivered as an mRNA construct, the level of mRNA deamination was dramatically reduced by an average of 34-fold (in the case of ABE7.10-d) to 134-fold (ABE8.17-m) (FIG. 55E), indicating that mRNA delivery can effectively reduce the frequency of cellular RNA editing.

Example 5: Adenine Base Editors for the Treatment of Hematological Disorders

ABE8 constructs were evaluated in human hematopoietic stem cells (HSC). Ex vivo manipulation and/or editing of HSCs prior to administration to patients as a cell therapy is a promising approach for the treatment of hematological disorders. It has been previously demonstrated that ABEs can introduce a T to C substitution at the −198 position of the promoter region of HBG1/2 (Gaudelli, N. M. et al. Programmable base editing of A*T to G*C in genomic DNA without DNA cleavage. Nature 551, 464-471, doi:10.1038/nature24644 (2017)). This naturally occurring allele yields Hereditary Persistence of Fetal Hemoglobin (HPFH) resulting in increased levels of γ-globin into adulthood, which can mitigate the defects in β-globin seen in sickle cell disease and β-thalassemia (Wienert, B. et al. KLF1 drives the expression of fetal hemoglobin in British HPFH. Blood 130, 803-807, doi:10.1182/blood-2017-02-767400 (2017)). With the goal of reproducing the HPFH phenotype and evaluating the clinical relevance of ABE8, CD34+ hematopoietic stem cells were isolated from two donors and transfected with mRNA encoding ABE8 editors and end-modified sgRNA placing the target A at position 7 within the protospacer.

The average ABE8 editing efficiencies at the −198 HBG1/2 promoter target site were 2-3× higher than either ABE7.10 construct at early time points (48h), and 1.3-2-fold higher than either ABE7.10 at the later time (144h) (FIG. 27B, FIGS. 28A and 28B, FIGS. 29A and 29B). These kinetic distinctions are clinically important for ex vivo therapies in which cell culturing must be kept to a minimum prior to administration of cell therapy.

Figure 27A:
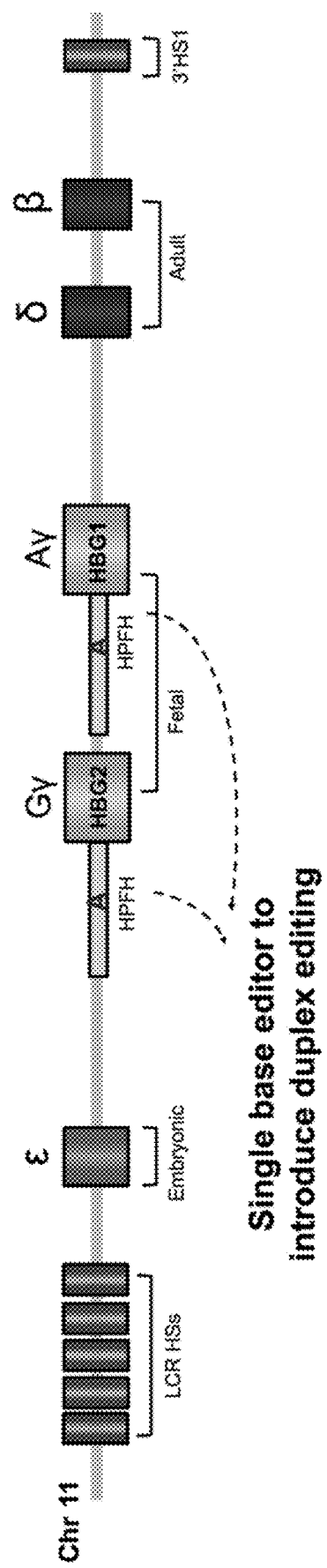
FIGS. 27A-27C depict A•T to G•C conversion and phenotypic outcomes in primary cells.
Figure 27B:
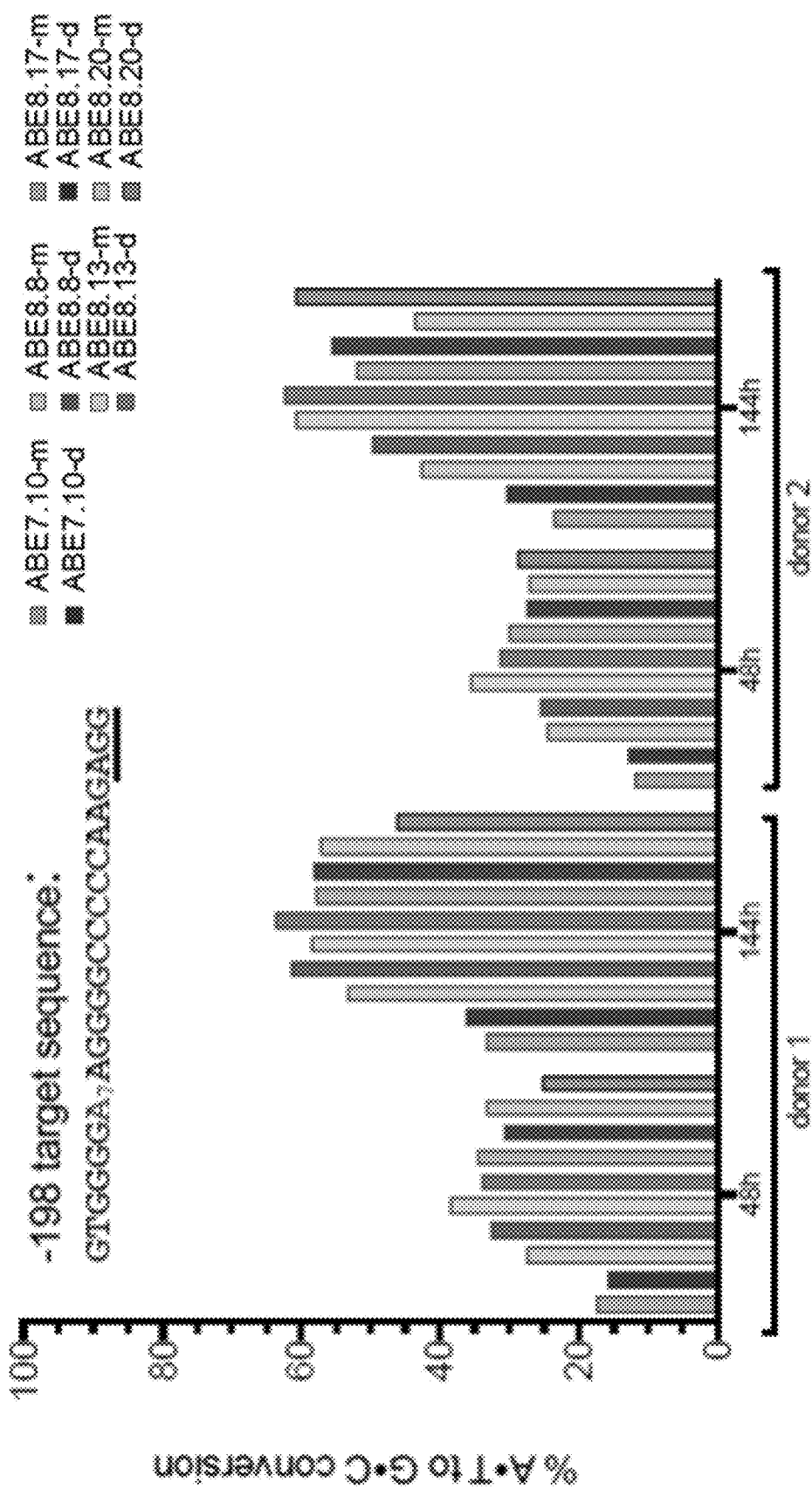
Figure 27C:
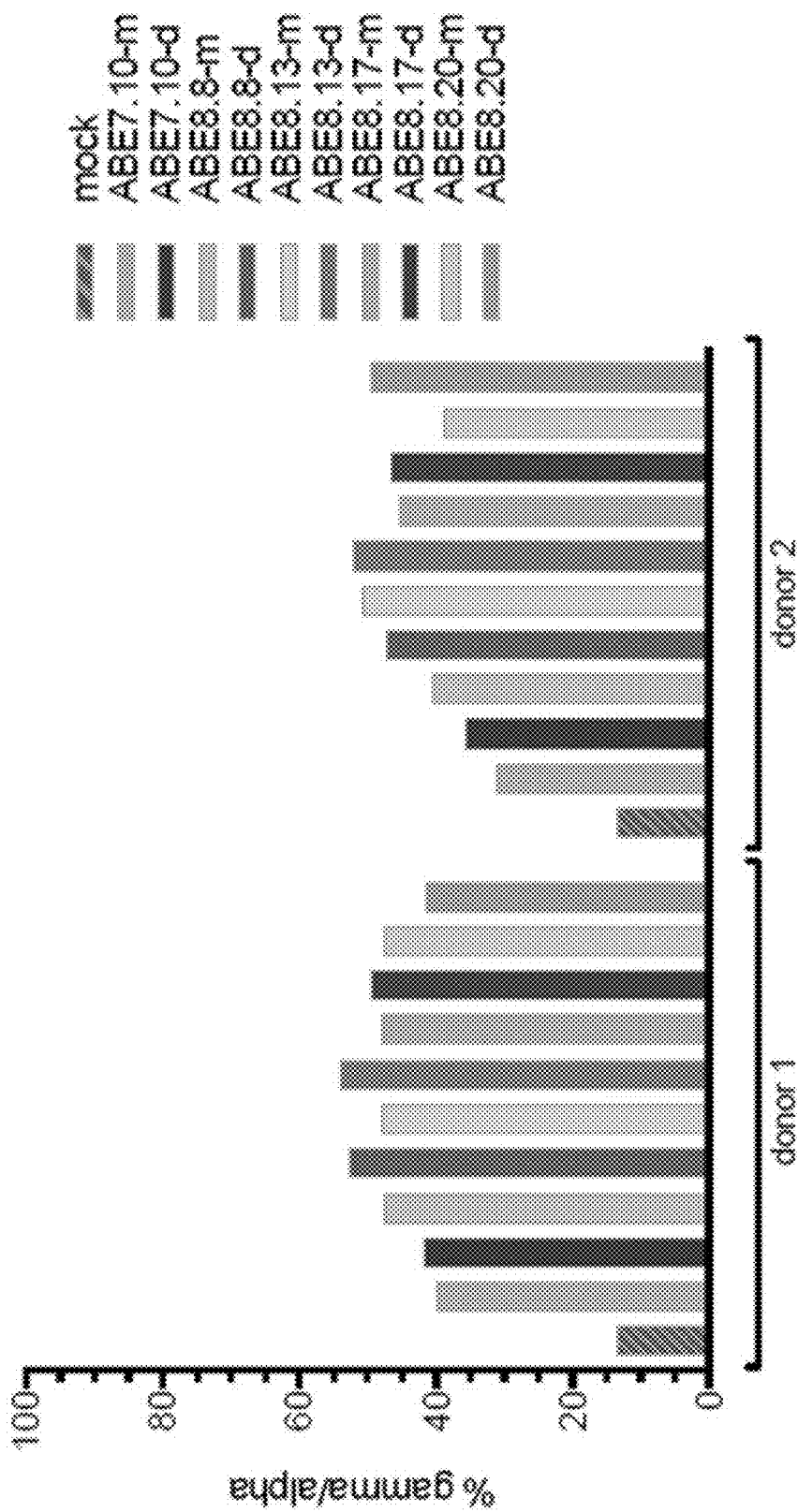
Figure 28A:
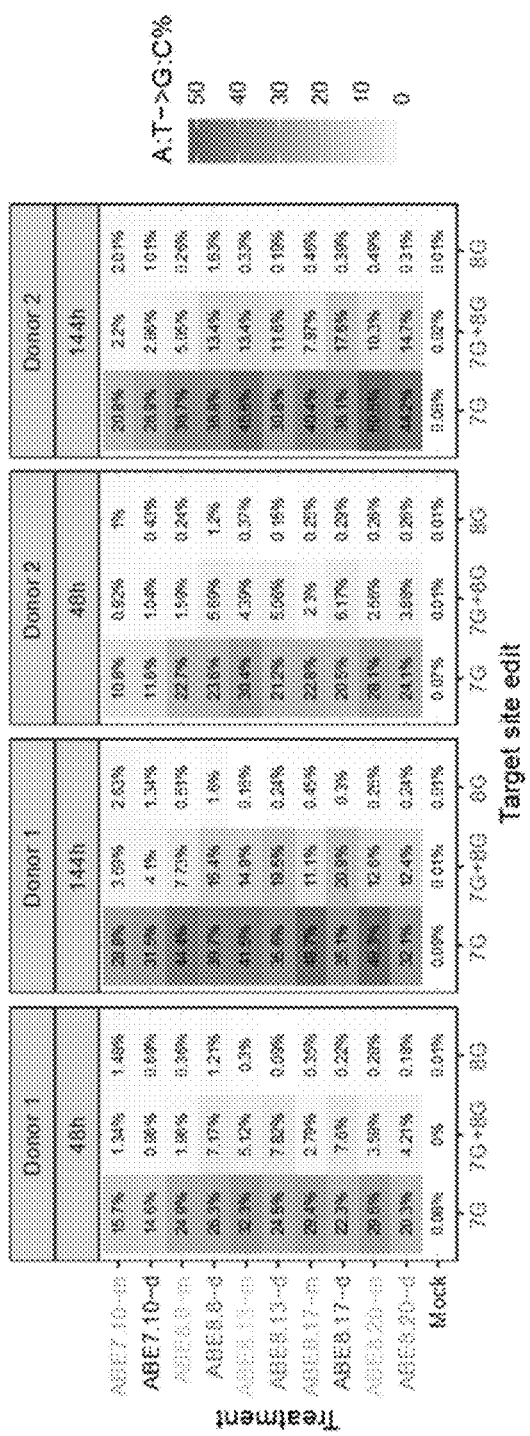
FIGS. 28A and 28B depict A•T to G•C conversion of CD34+ cells treated with ABE8 at the −198 promoter site upstream of HBG1/2.
Figure 28B:
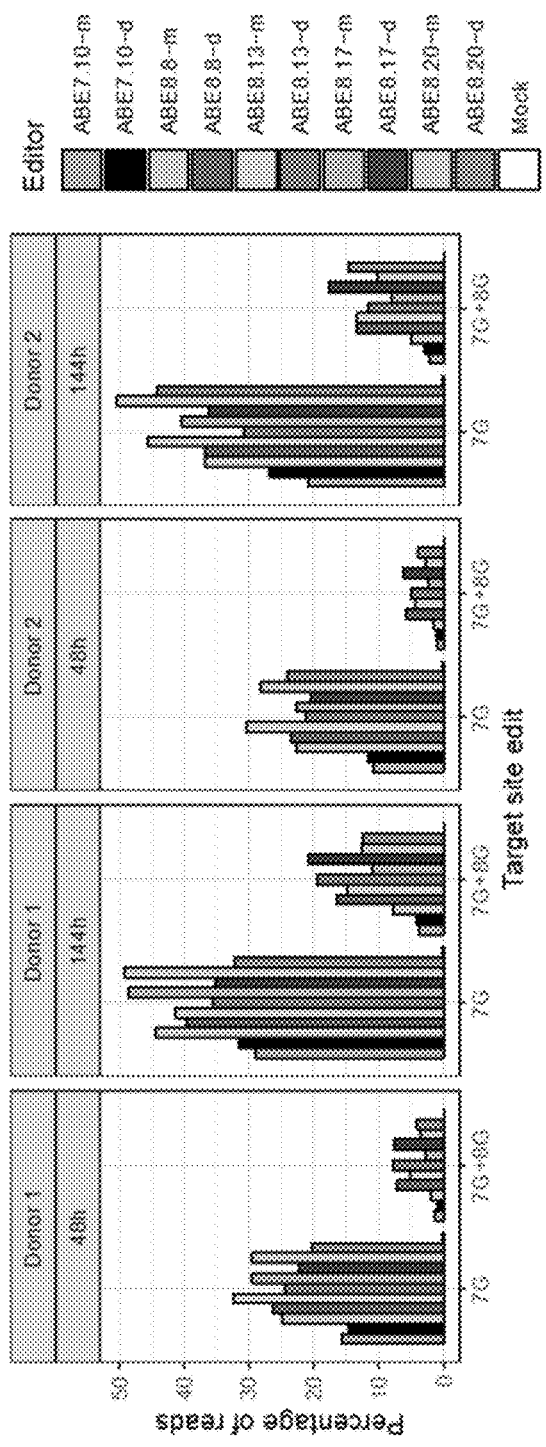
Figure 29A:
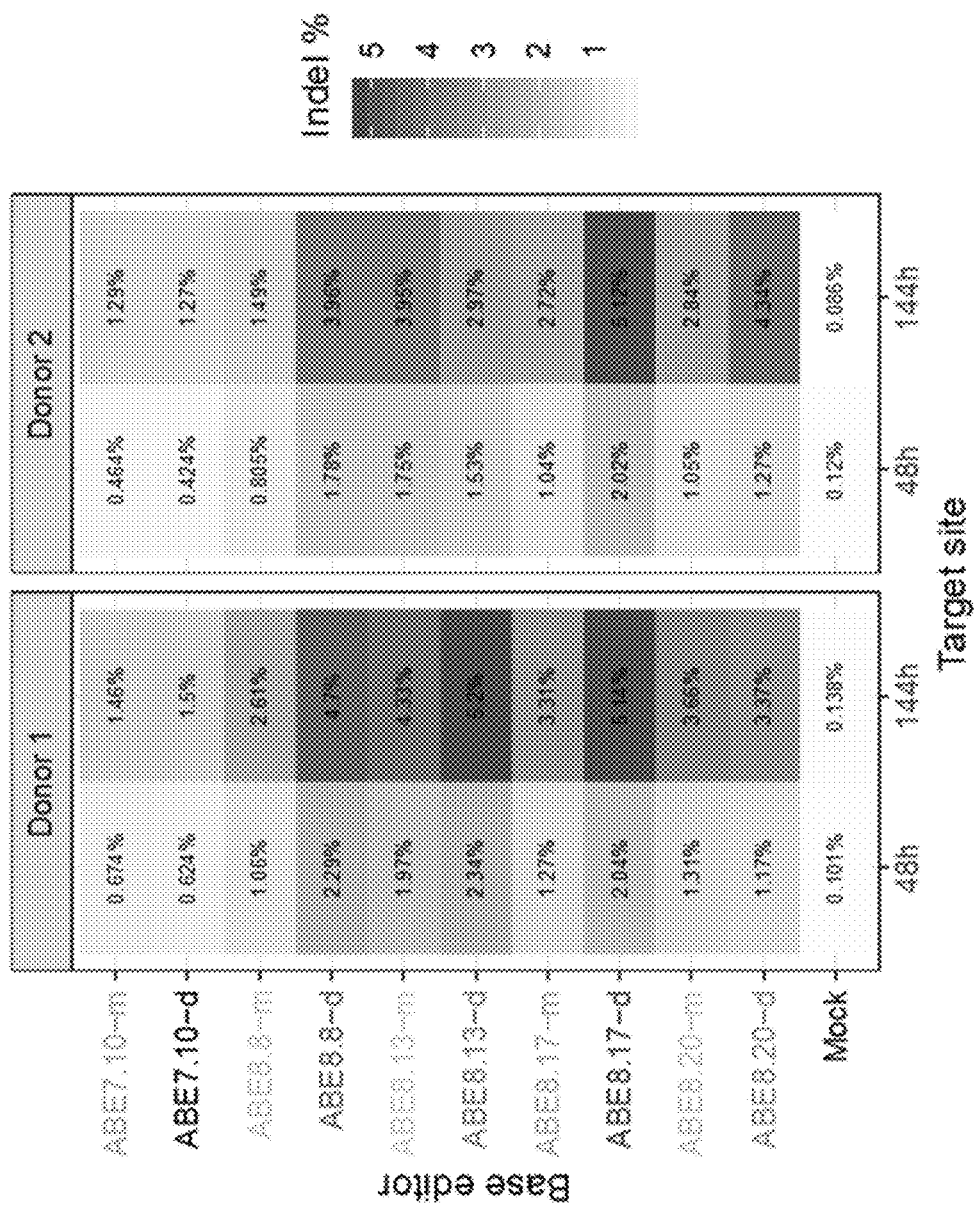
FIGS. 29A and 29B are heat maps depicting INDEL frequency of CD34+ cells treated with ABE8 at the −198 site of the gamma-globin promoter. Frequencies shown from two donors at 48h and 144h time points. Complete A•T to G•C conversion at the HBG1/2-198 promoter target site creates a poly-G stretch of 10-nt. Such homopolymer runs often increase the rate of PCR- and sequencing-induced errors, leading to the appearance of elevated INDEL frequencies at this site.
Figure 29B:
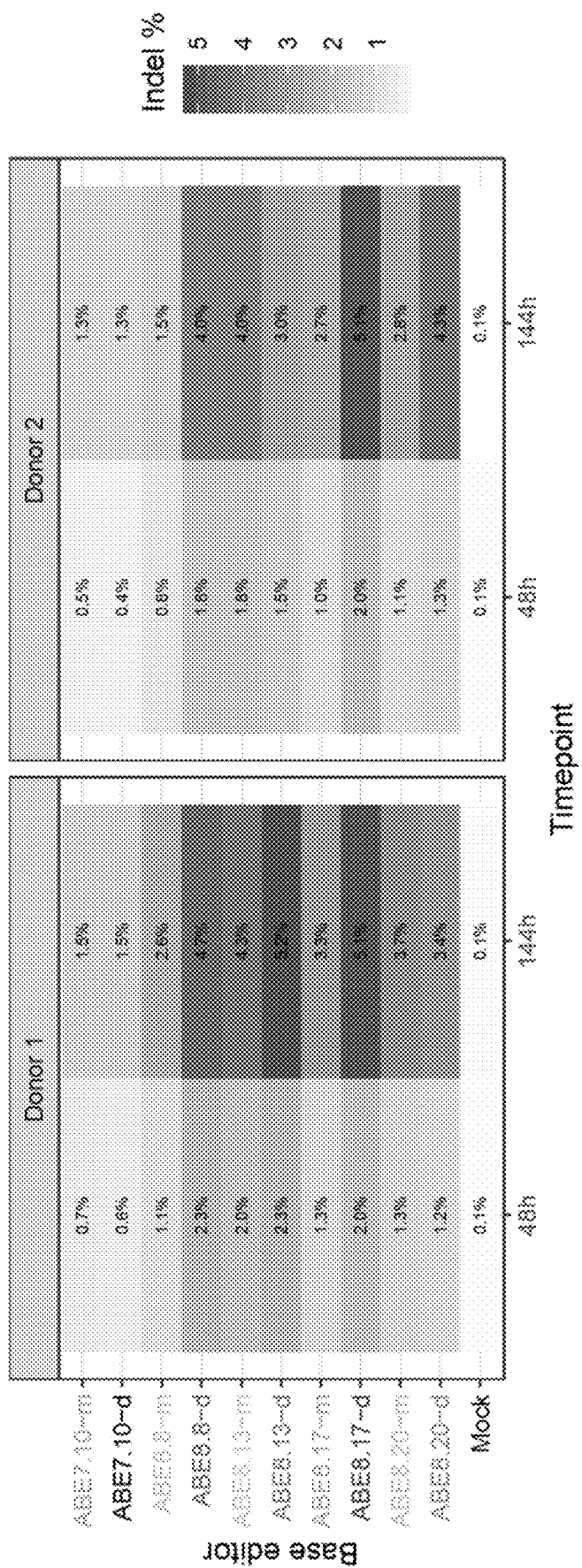
Figure 30:
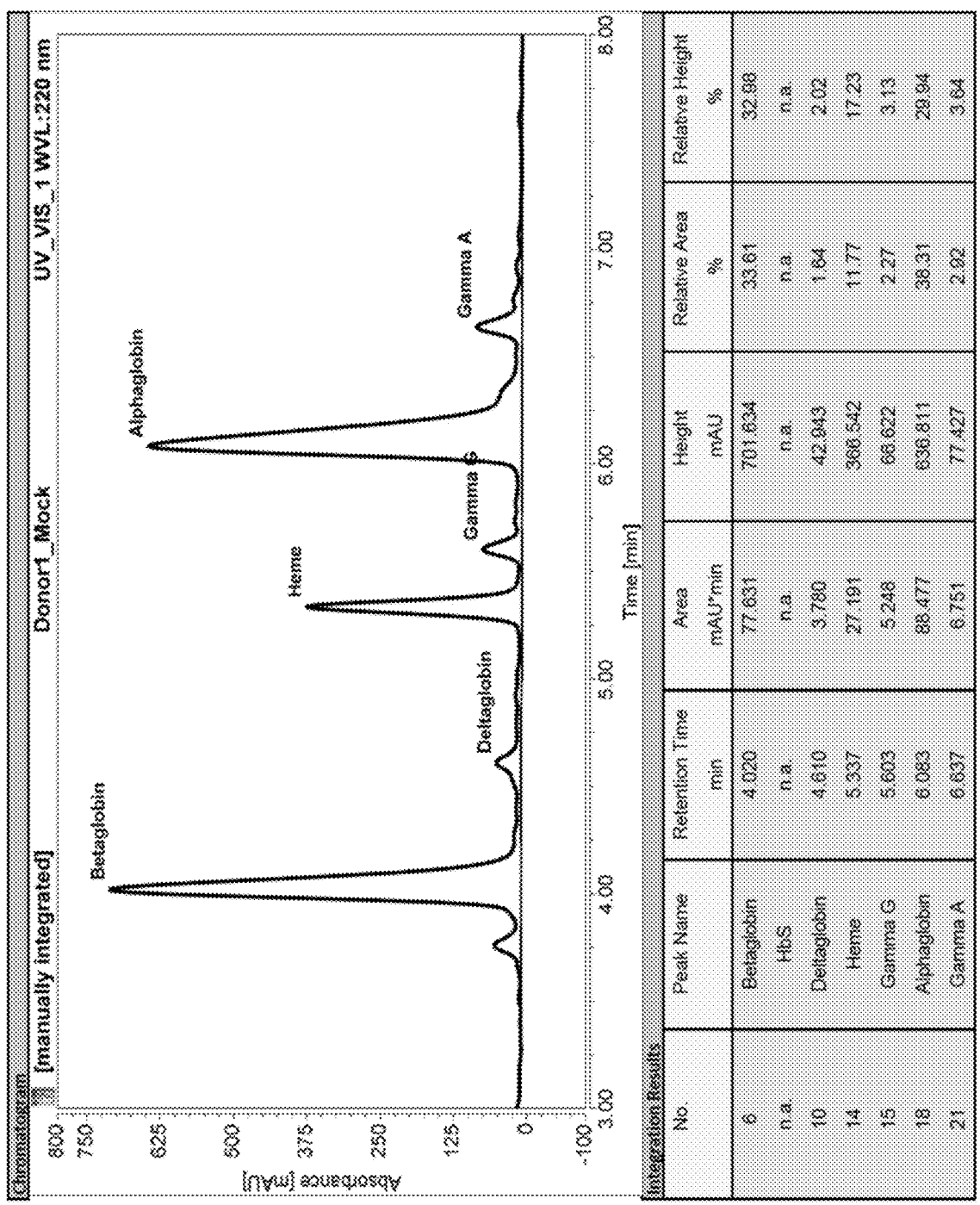
FIG. 30 depicts an UHPLC UV-Vis trace (220 nm) and integration of globin chain levels of untreated differentiated CD34+ cells (donor 1).
Figure 31:
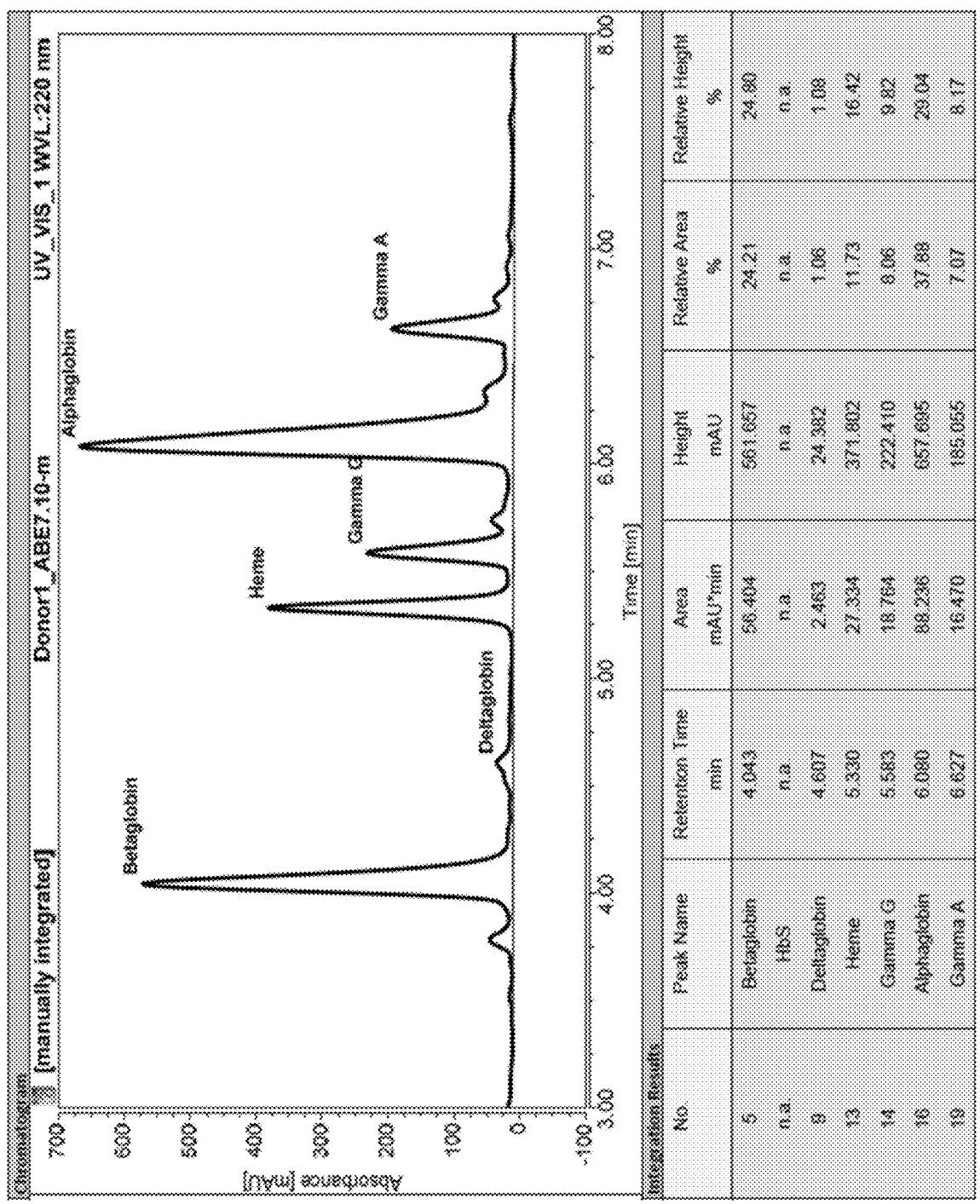
FIG. 31 depicts an UHPLC UV-Vis trace (220 nm) and integration of globin chain levels of differentiated CD34+ cells treated with ABE7.10-m (donor1)
Figure 32:
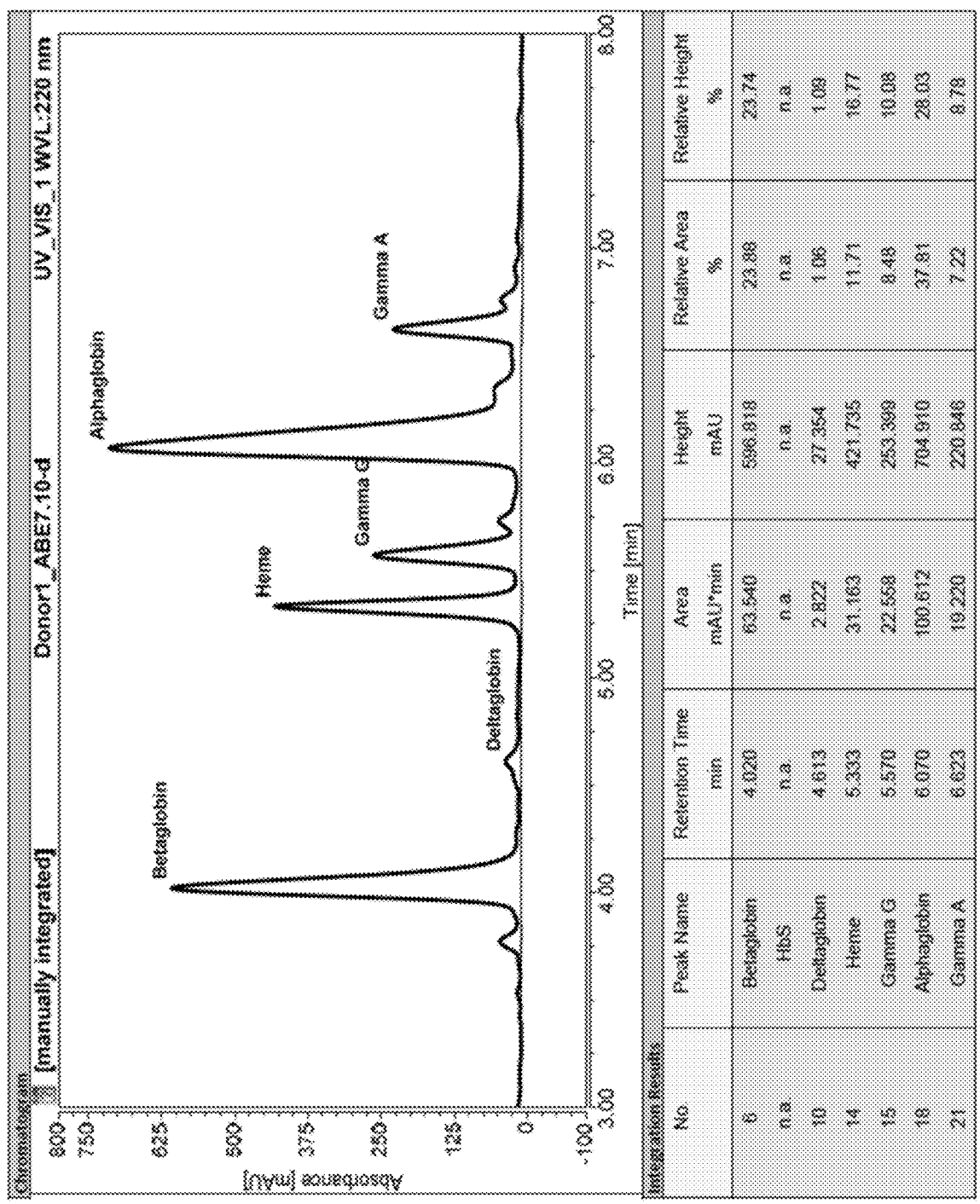
FIG. 32 depicts an UHPLC UV-Vis trace (220 nm) and integration of globin chain levels of differentiated CD34+ cells treated with ABE7.10-d (donor1).
Figure 33:
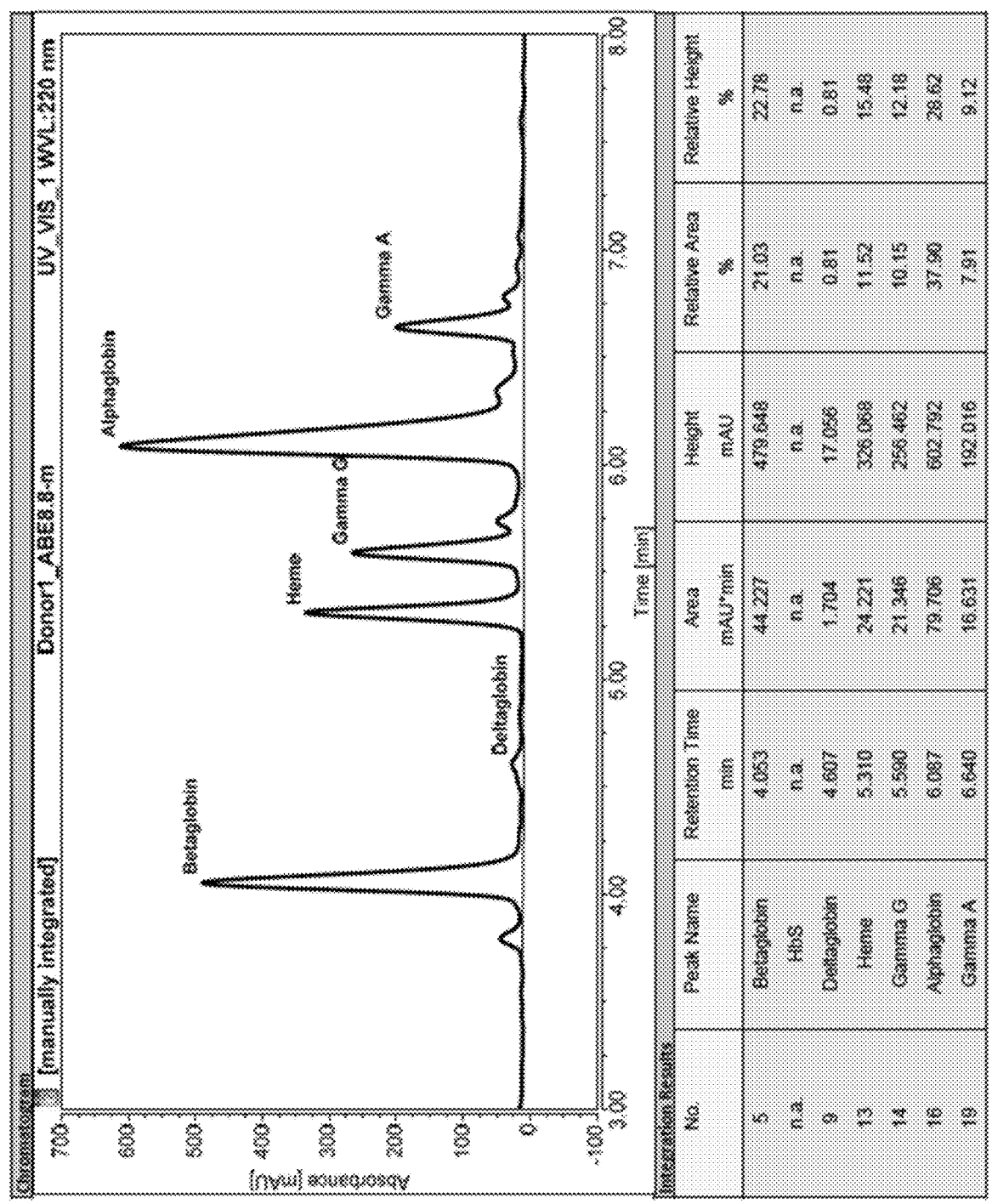
FIG. 33 depicts an UHPLC UV-Vis trace (220 nm) and integration of globin chain levels of differentiated CD34+ cells treated with ABE8.8-m (donor1)
Figure 34:
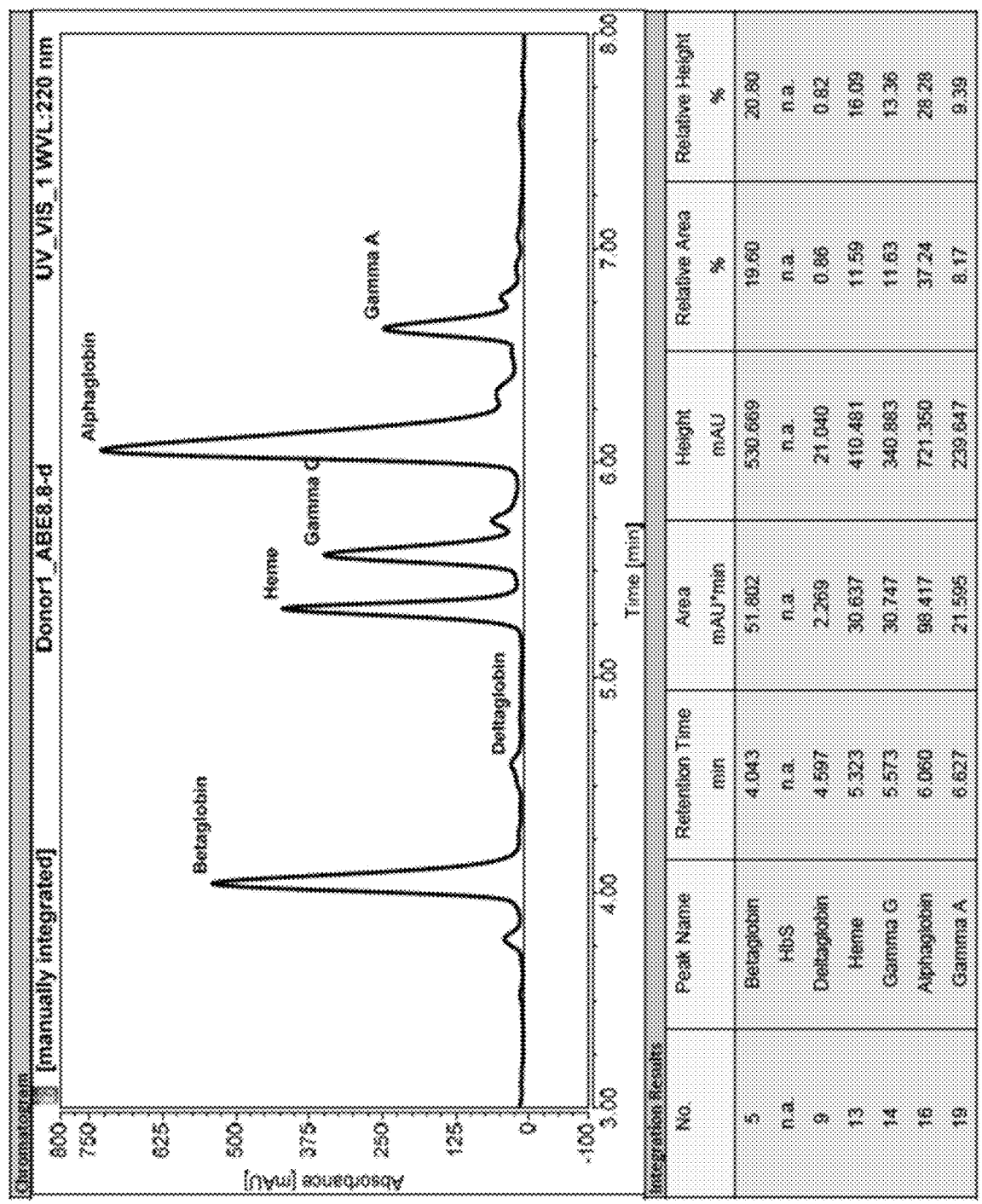
FIG. 34 depicts an UHPLC UV-Vis trace (220 nm) and integration of globin chain levels of differentiated CD34+ cells treated with ABE8.8-d (donor1).
Figure 35:
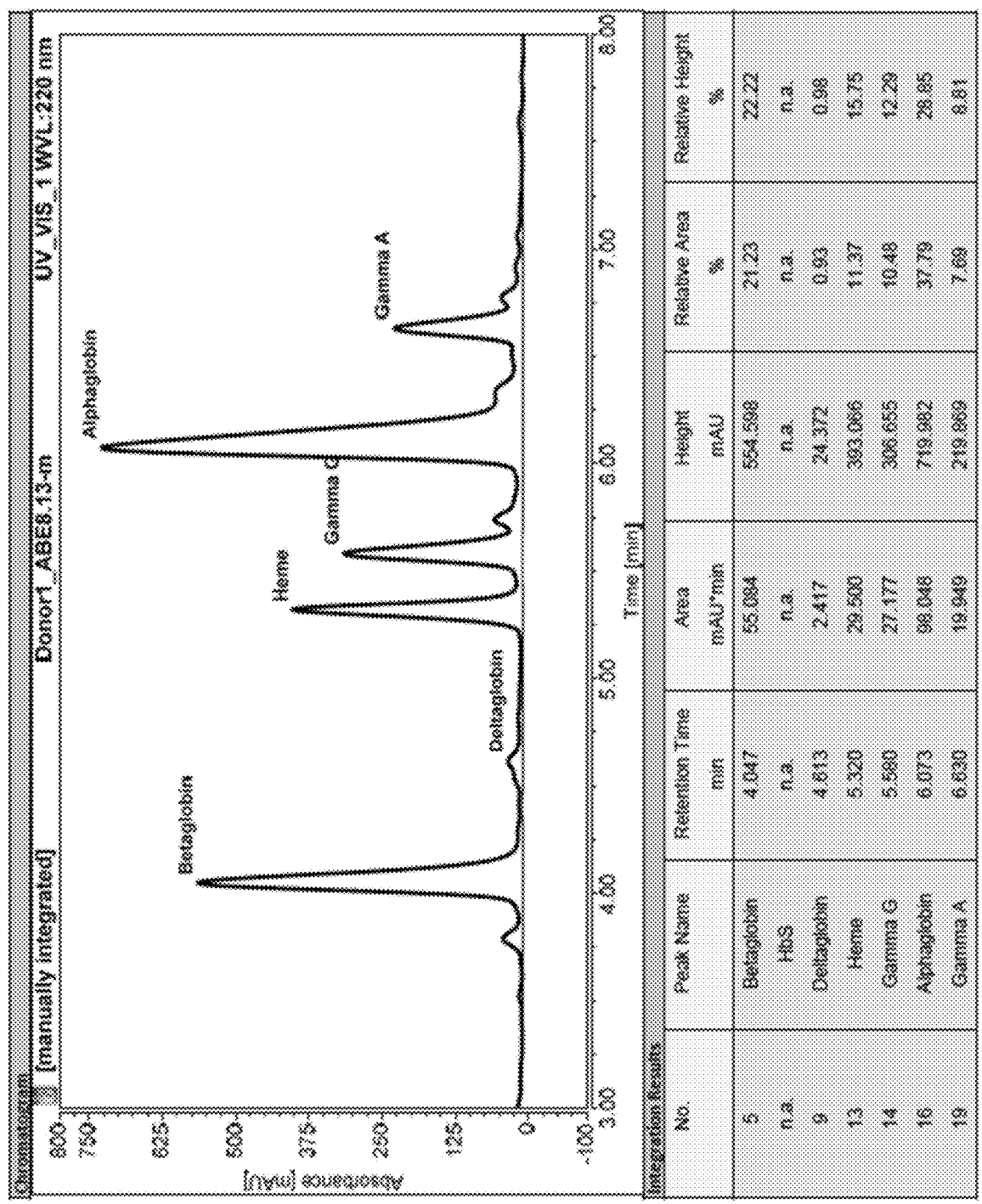
FIG. 35 depicts an UHPLC UV-Vis trace (220 nm) and integration of globin chain levels of differentiated CD34+ cells treated with ABE8.13-m (donor1).
Figure 36:
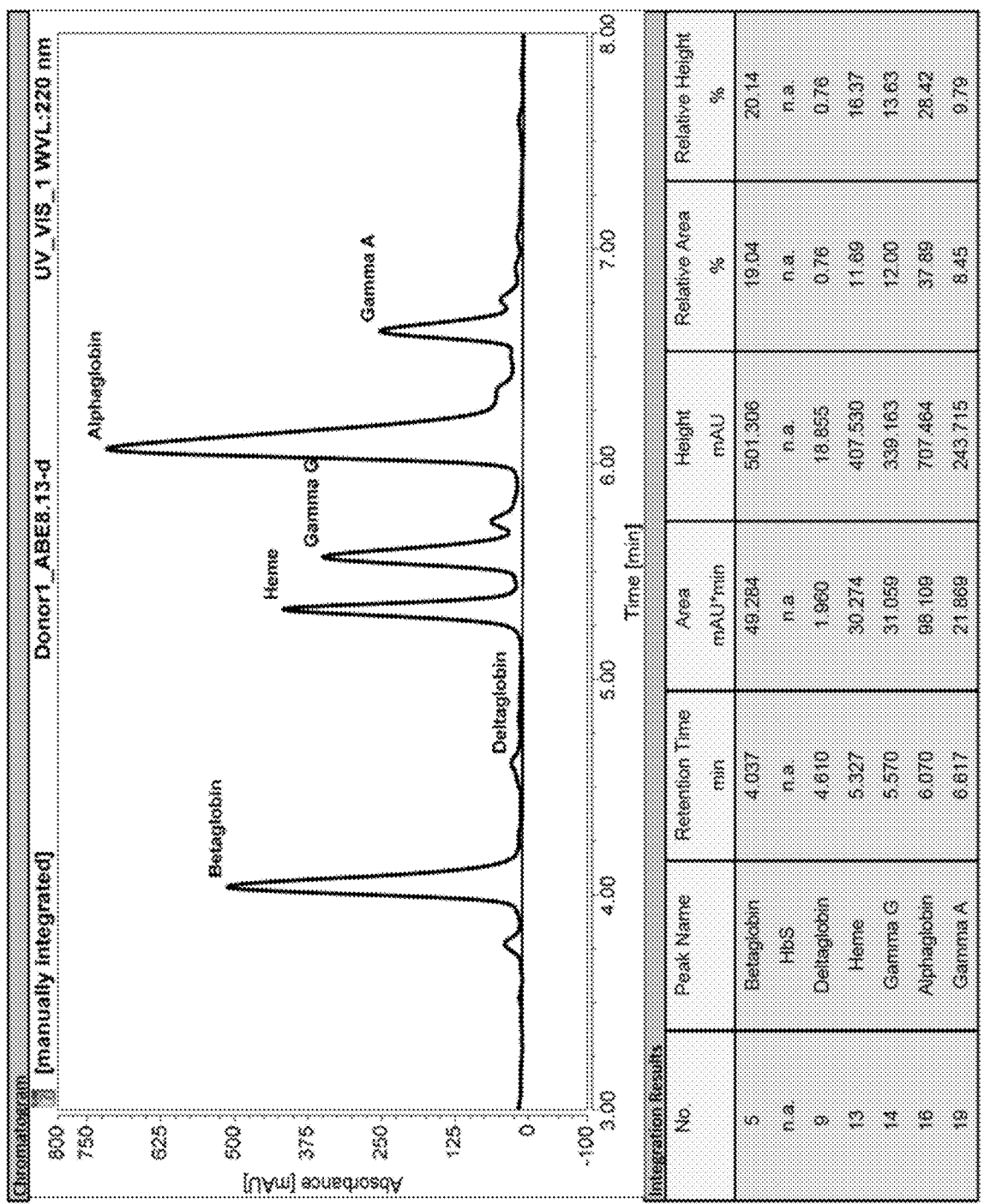
FIG. 36 depicts an UHPLC UV-Vis trace (220 nm) and integration of globin chain levels of differentiated CD34+ cells treated with ABE8.13-d (donor1).
Figure 37:
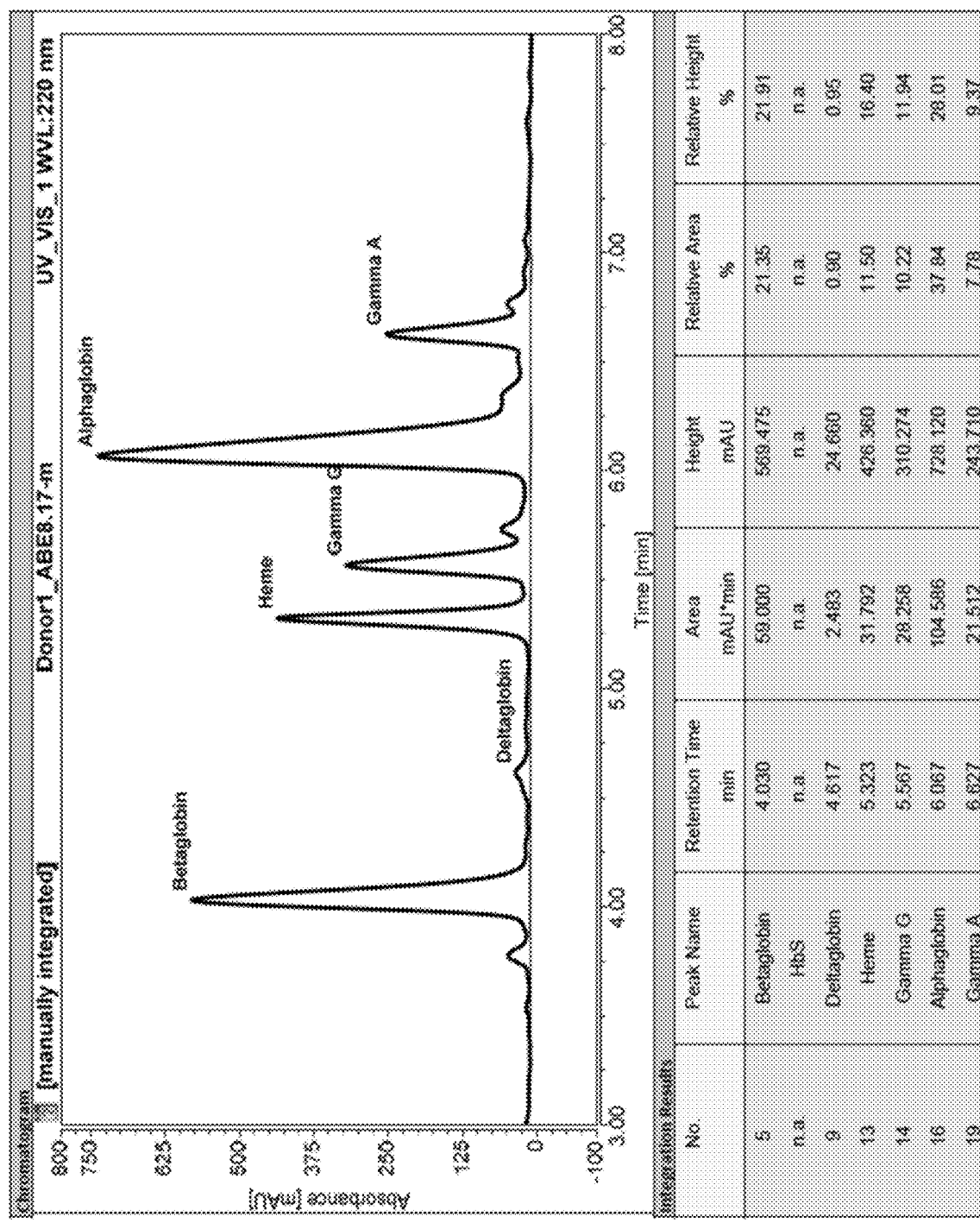
FIG. 37 depicts an UHPLC UV-Vis trace (220 nm) and integration of globin chain levels of differentiated CD34+ cells treated with ABE8.17-m (donor1).
Figure 38:
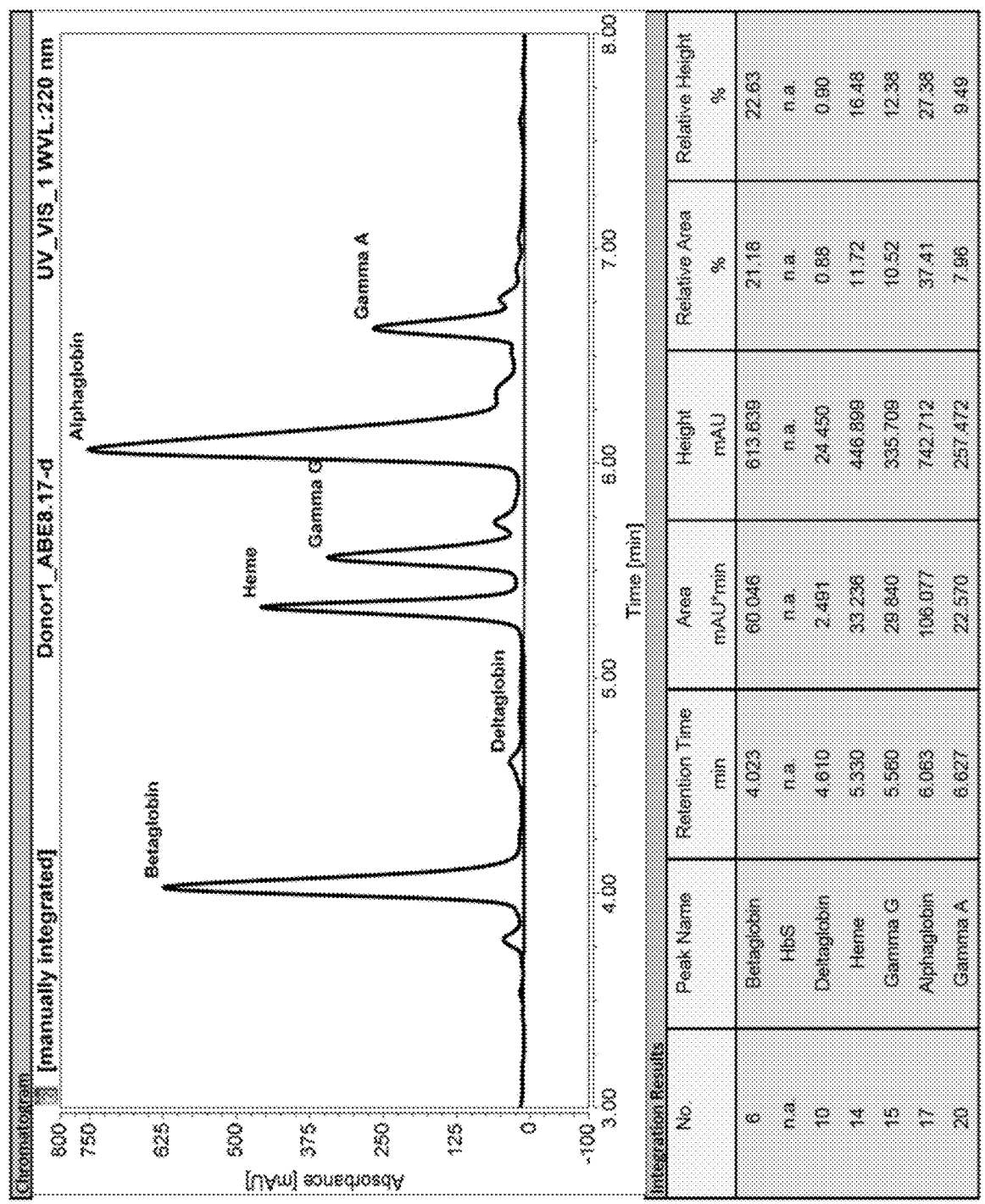
FIG. 38 depicts an UHPLC UV-Vis trace (220 nm) and integration of globin chain levels of differentiated CD34+ cells treated with ABE8.17-d (donor1).
Figure 39:
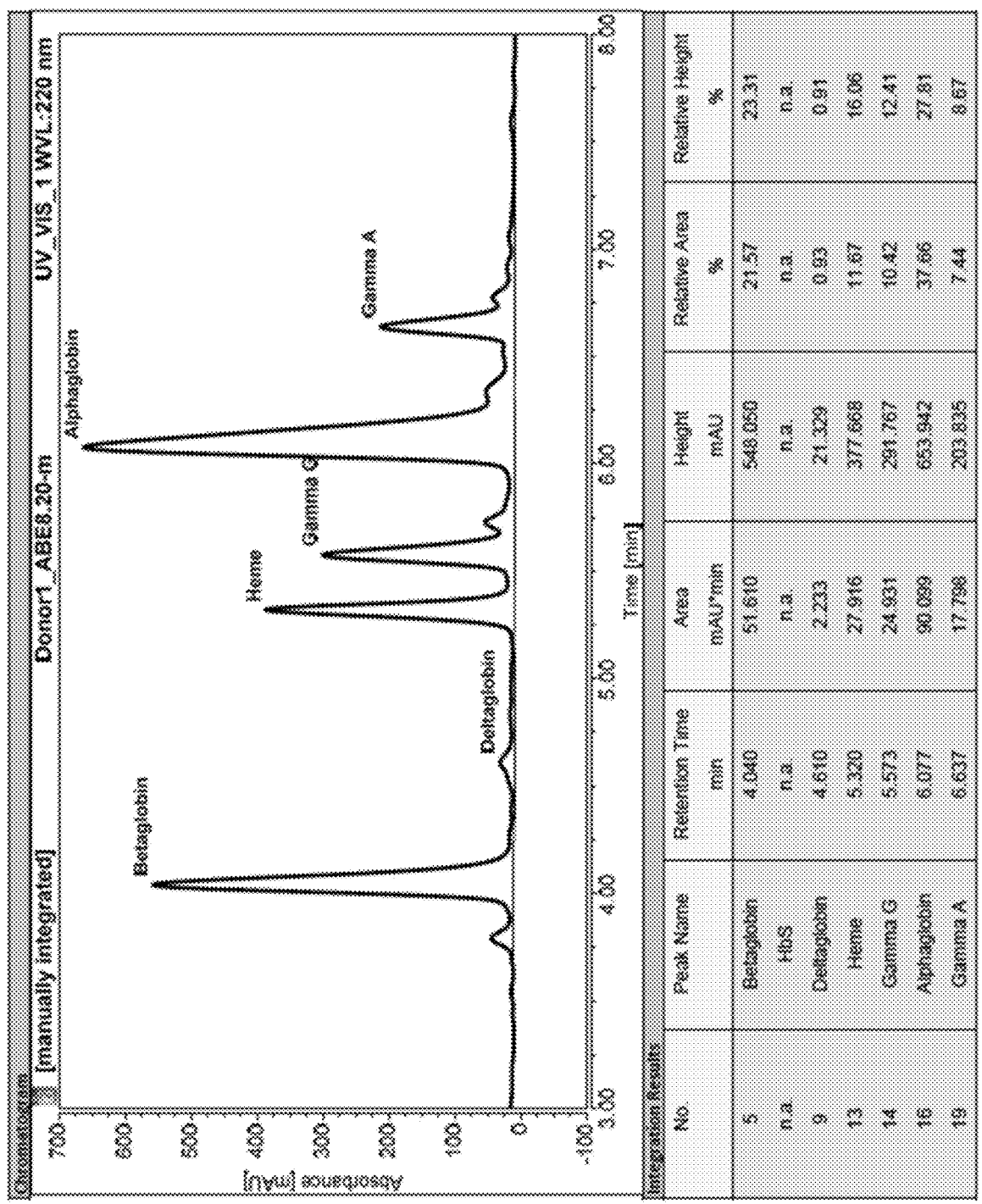
FIG. 39 depicts an UHPLC UV-Vis trace (220 nm) and integration of globin chain levels of differentiated CD34+ cells treated with ABE8.20-m (donor1).
Figure 40:
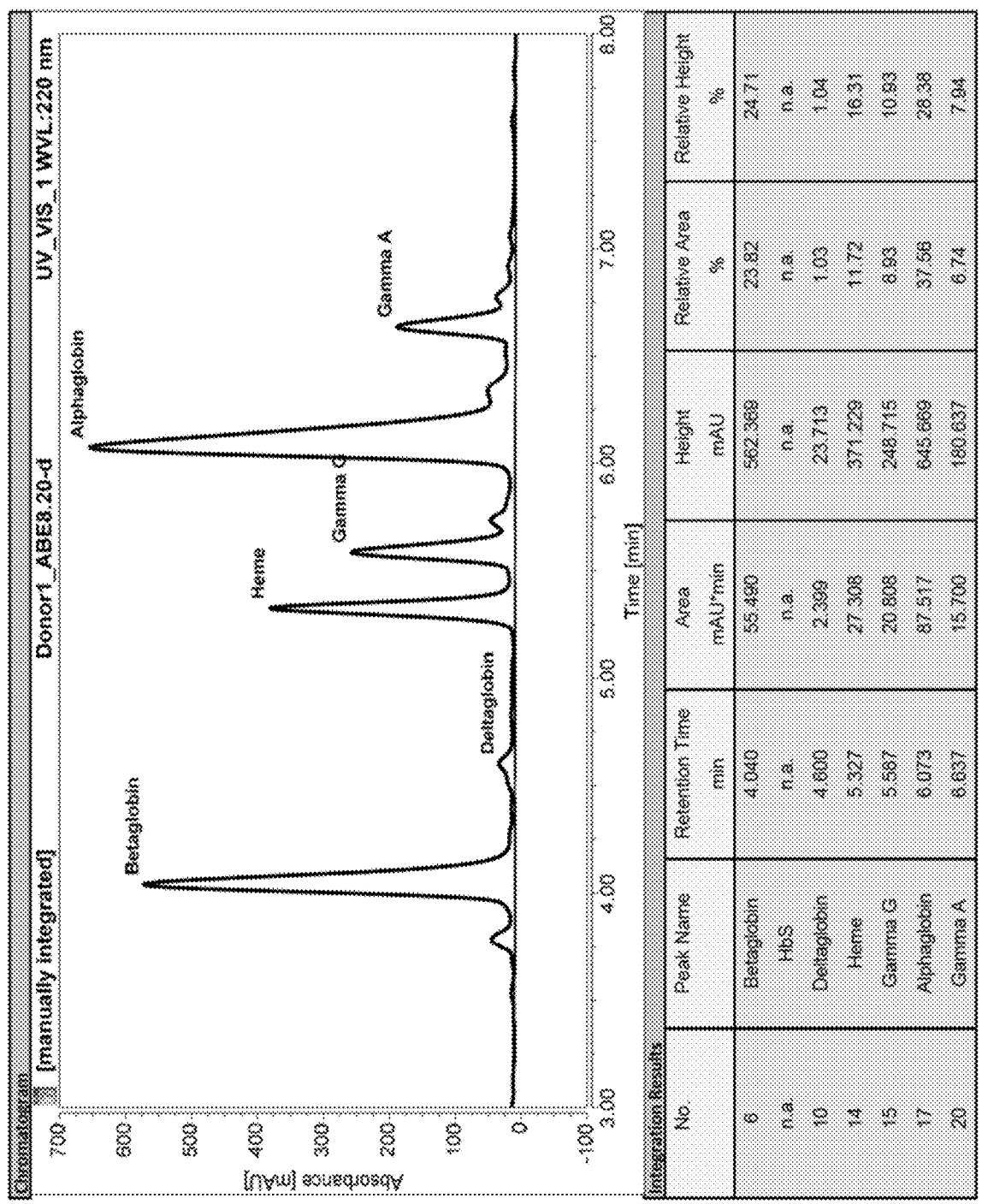
FIG. 40 depicts an UHPLC UV-Vis trace (220 nm) and integration of globin chain levels of differentiated CD34+ cells treated with ABE8.20-d (donor 1).
Figure 41:
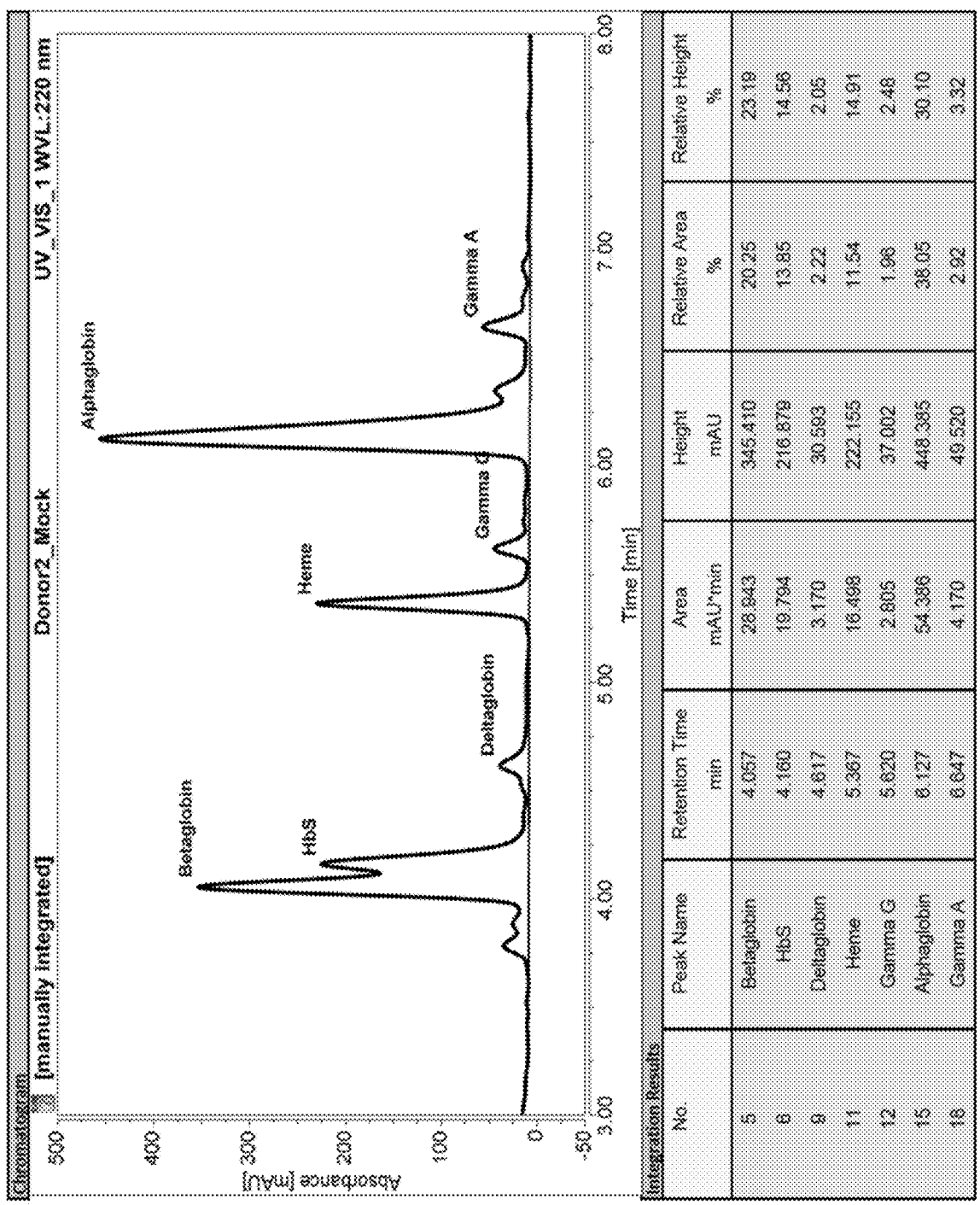
FIG. 41 depicts an UHPLC UV-Vis trace (220 nm) and integration of globin chain levels of differentiated CD34+ cells untreated (donor 2). Note: donor 2 is heterozygous for sickle cell disease.
Figure 42:
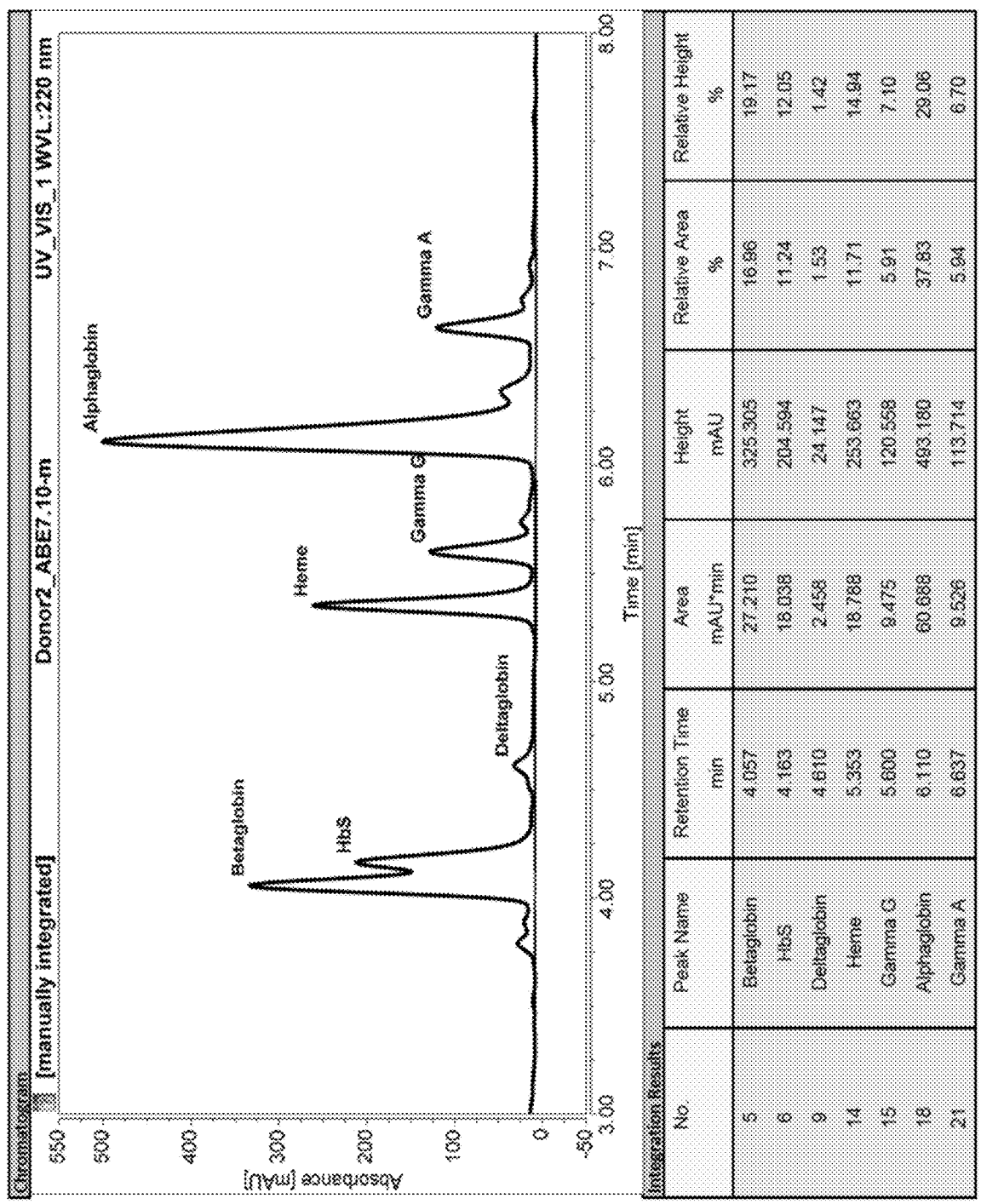
FIG. 42 depicts an UHPLC UV-Vis trace (220 nm) and integration of globin chain levels of differentiated CD34+ cells treated with ABE7.10-m (donor 2). Note: donor 2 is heterozygous for sickle cell disease.
Figure 43:
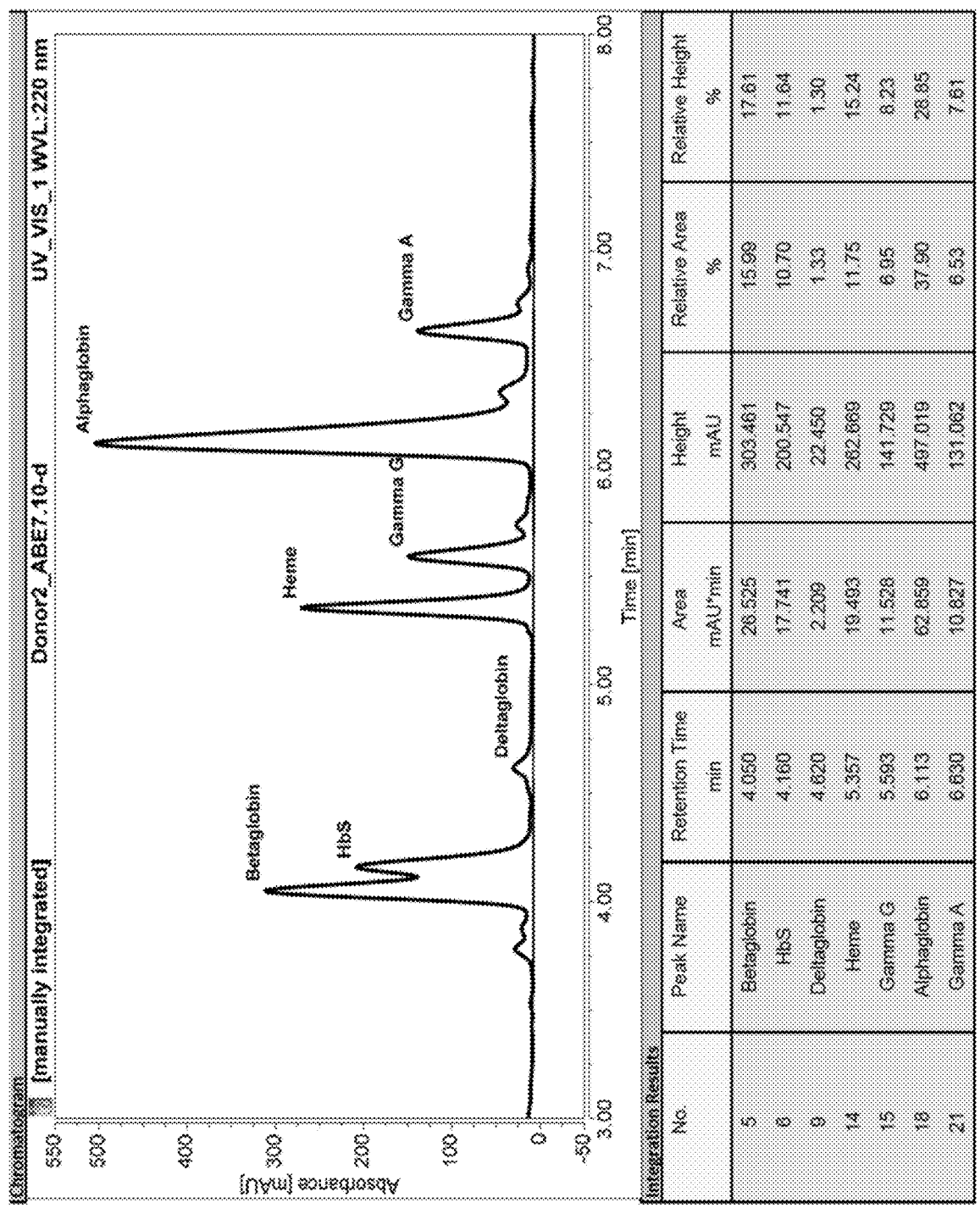
FIG. 43 depicts an UHPLC UV-Vis trace (220 nm) and integration of globin chain levels of differentiated CD34+ cells treated with ABE7.10-d (donor 2). Note: donor 2 is heterozygous for sickle cell disease.
Figure 44:
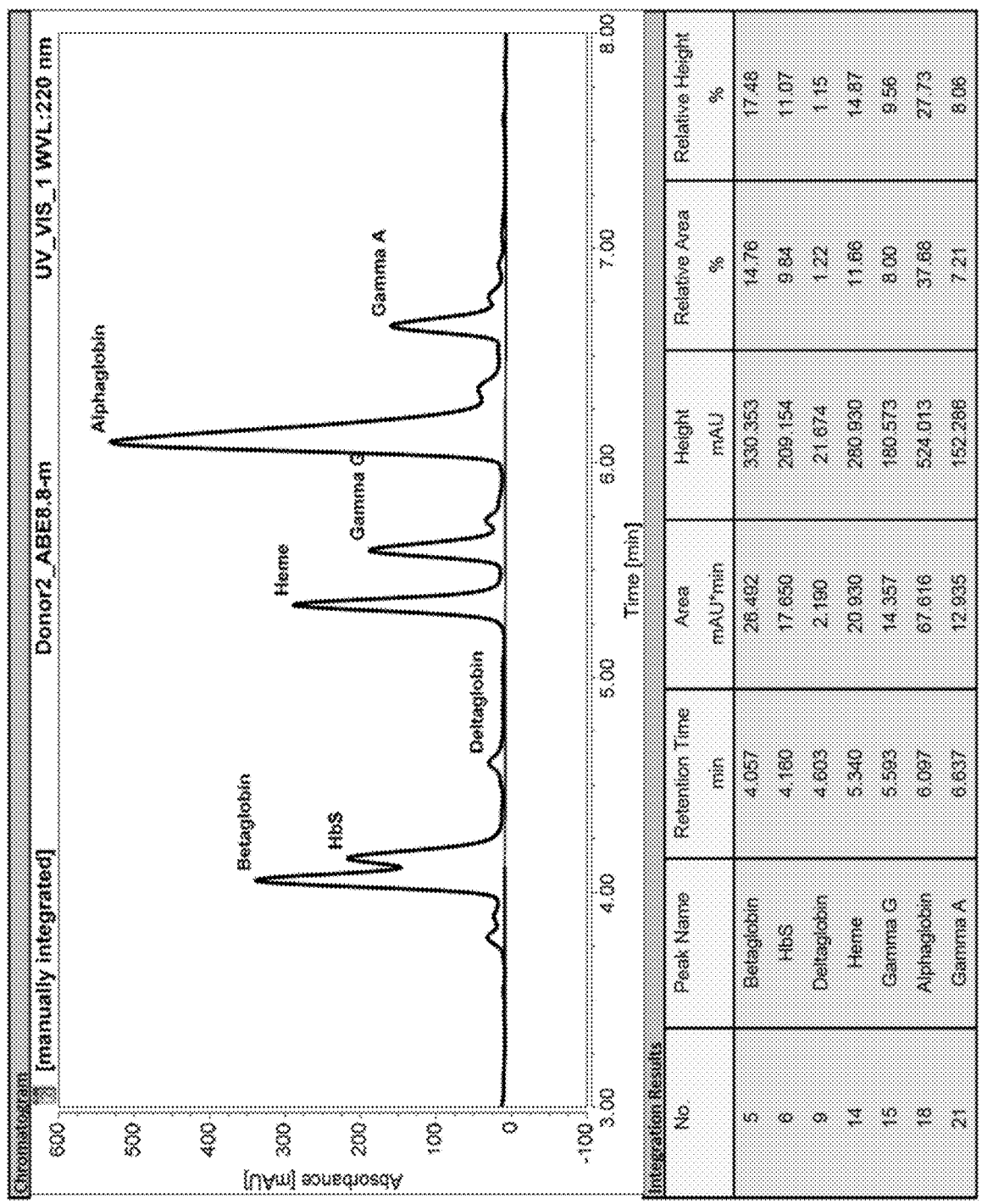
FIG. 44 depicts an UHPLC UV-Vis trace (220 nm) and integration of globin chain levels of differentiated CD34+ cells treated with ABE8.8-m (donor 2). Note: donor 2 is heterozygous for sickle cell disease.
Figure 45:
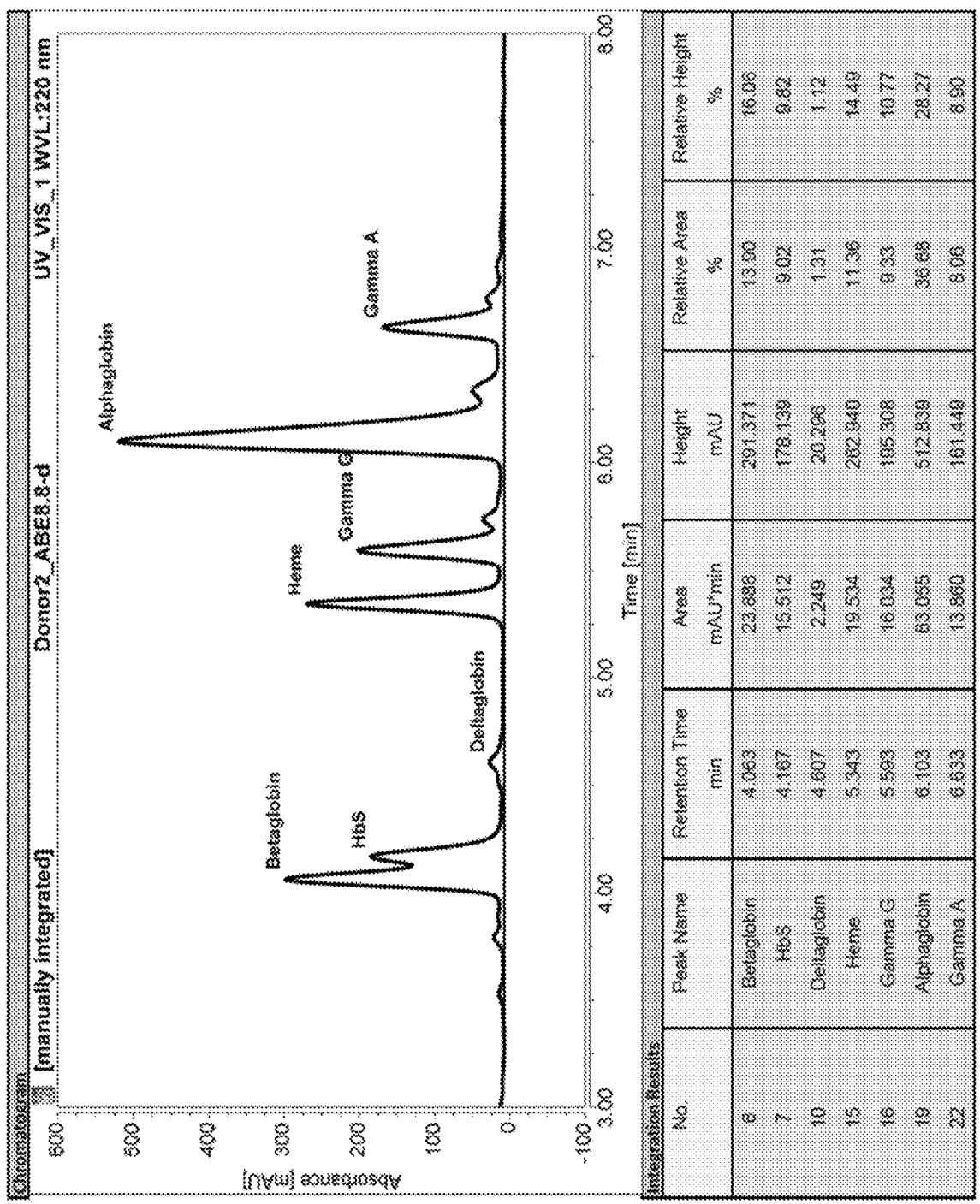
FIG. 45 depicts an UHPLC UV-Vis trace (220 nm) and integration of globin chain levels of differentiated CD34+ cells treated with ABE8.8-d (donor 2). Note: donor 2 is heterozygous for sickle cell disease.
Figure 46:
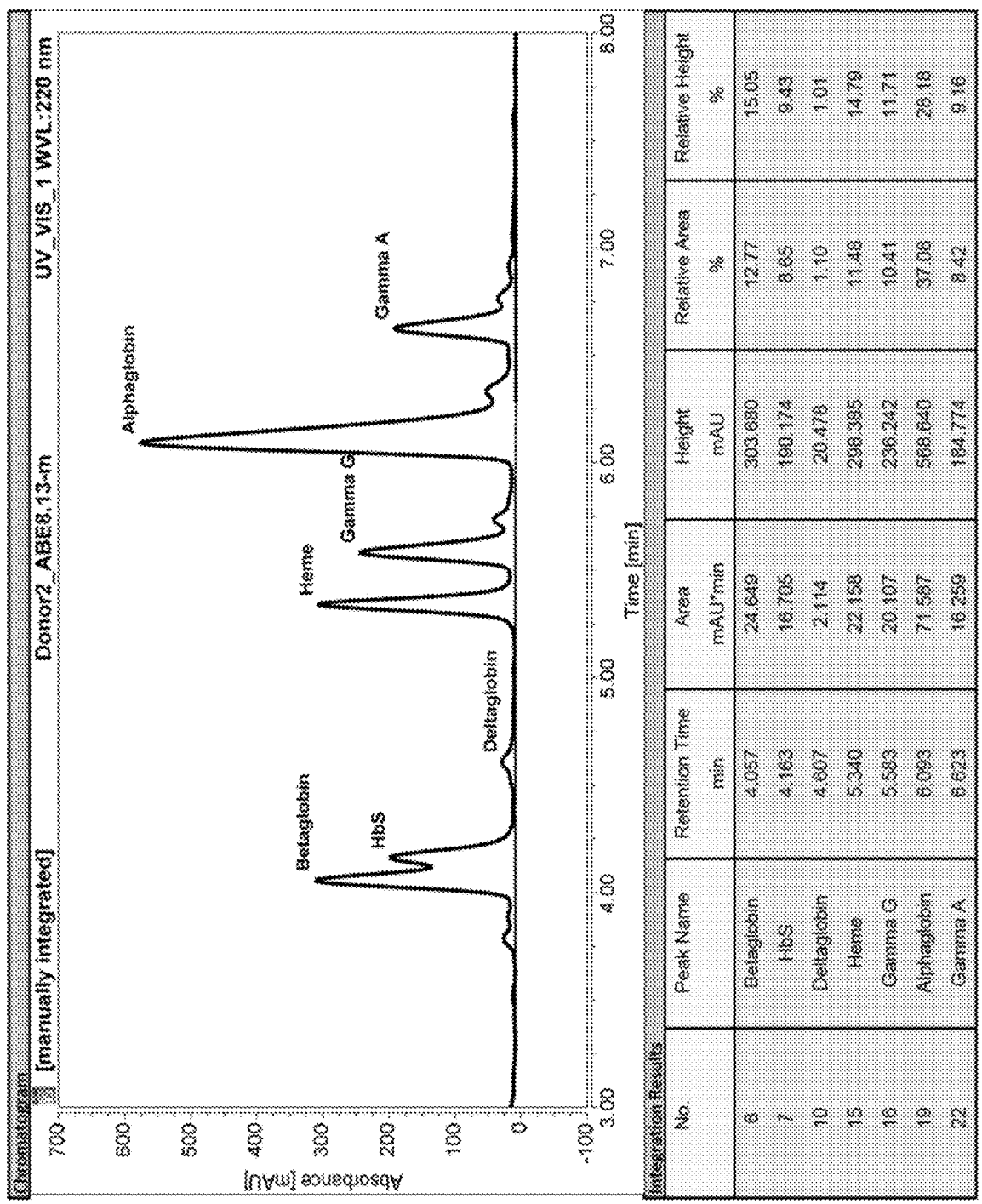
FIG. 46 depicts an UHPLC UV-Vis trace (220 nm) and integration of globin chain levels of differentiated CD34+ cells treated with ABE8.13-m (donor 2). Note: donor 2 is heterozygous for sickle cell disease.
Figure 47:
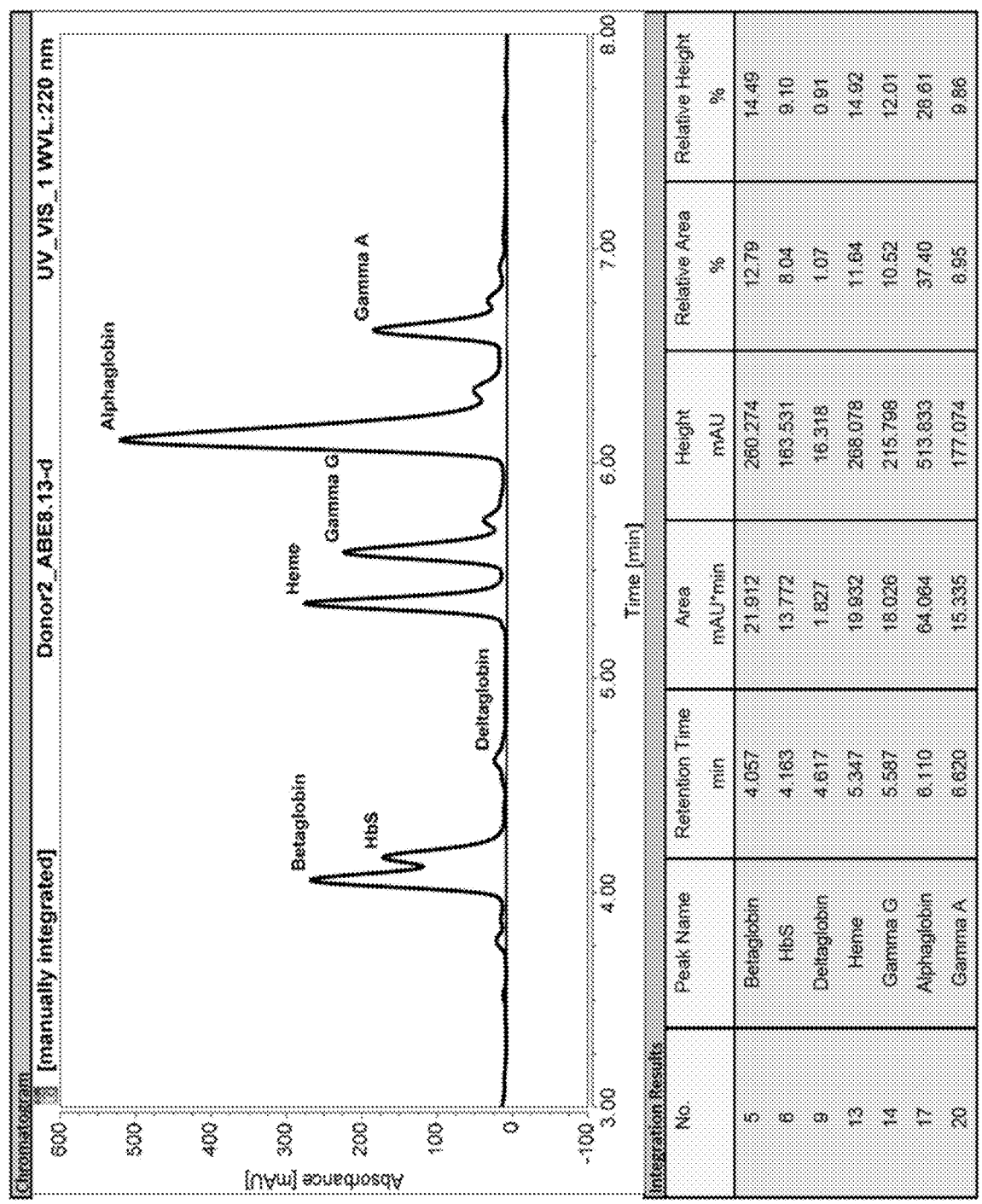
FIG. 47 depicts an UHPLC UV-Vis trace (220 nm) and integration of globin chain levels of differentiated CD34+ cells treated with ABE8.13-d (donor 2). Note: donor 2 is heterozygous for sickle cell disease.
Figure 48A:
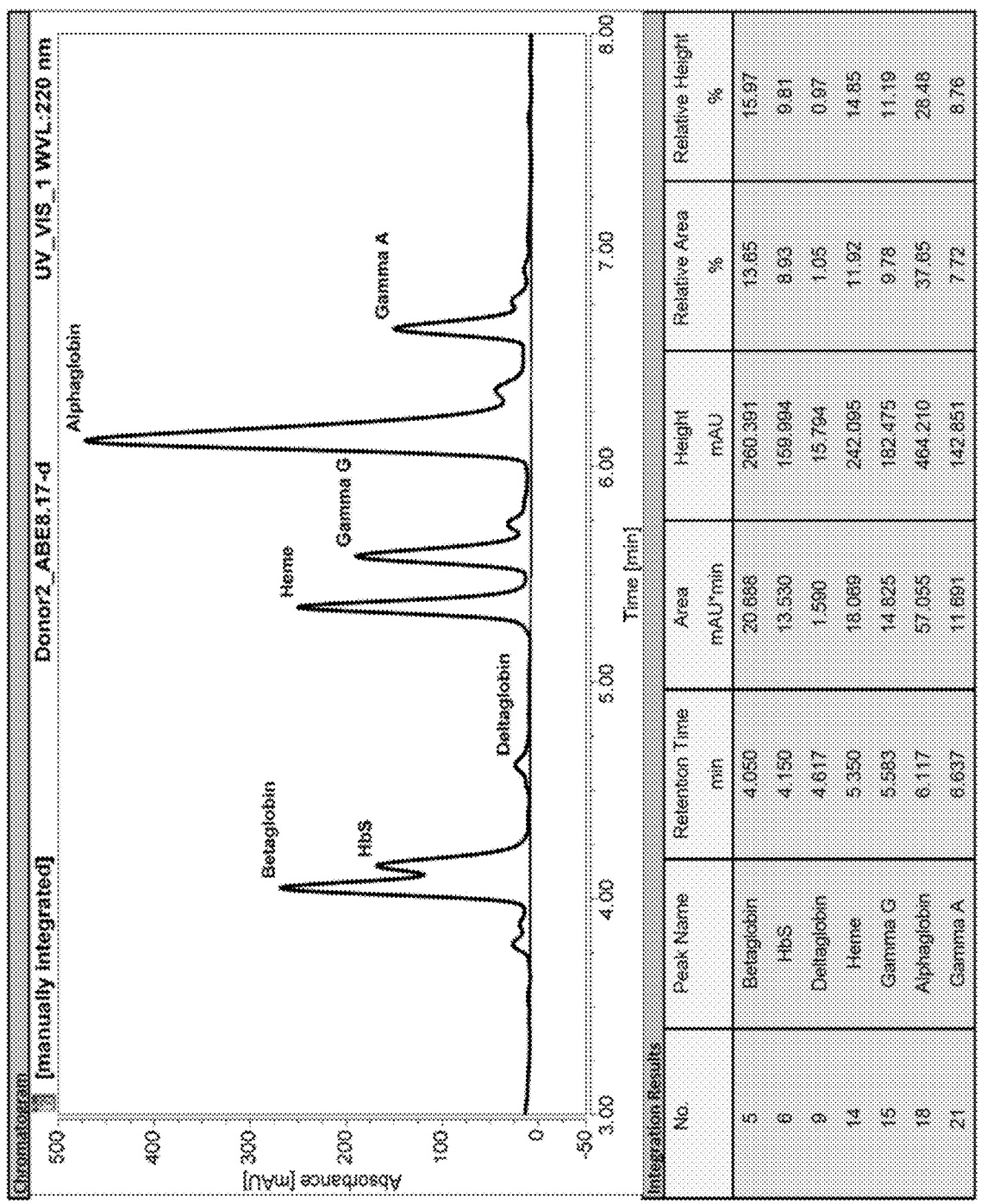
FIGS. 48A and 48B depict an UHPLC UV-Vis trace (220 nm) and integration of globin chain levels of differentiated CD34+ cells treated with ABE8.17-d (donor 2; Note: donor 2 is heterozygous for sickle cell disease) (FIG. 48A) or with ABE8.17-m (donor1) (FIG. 48B).
Figure 48B:
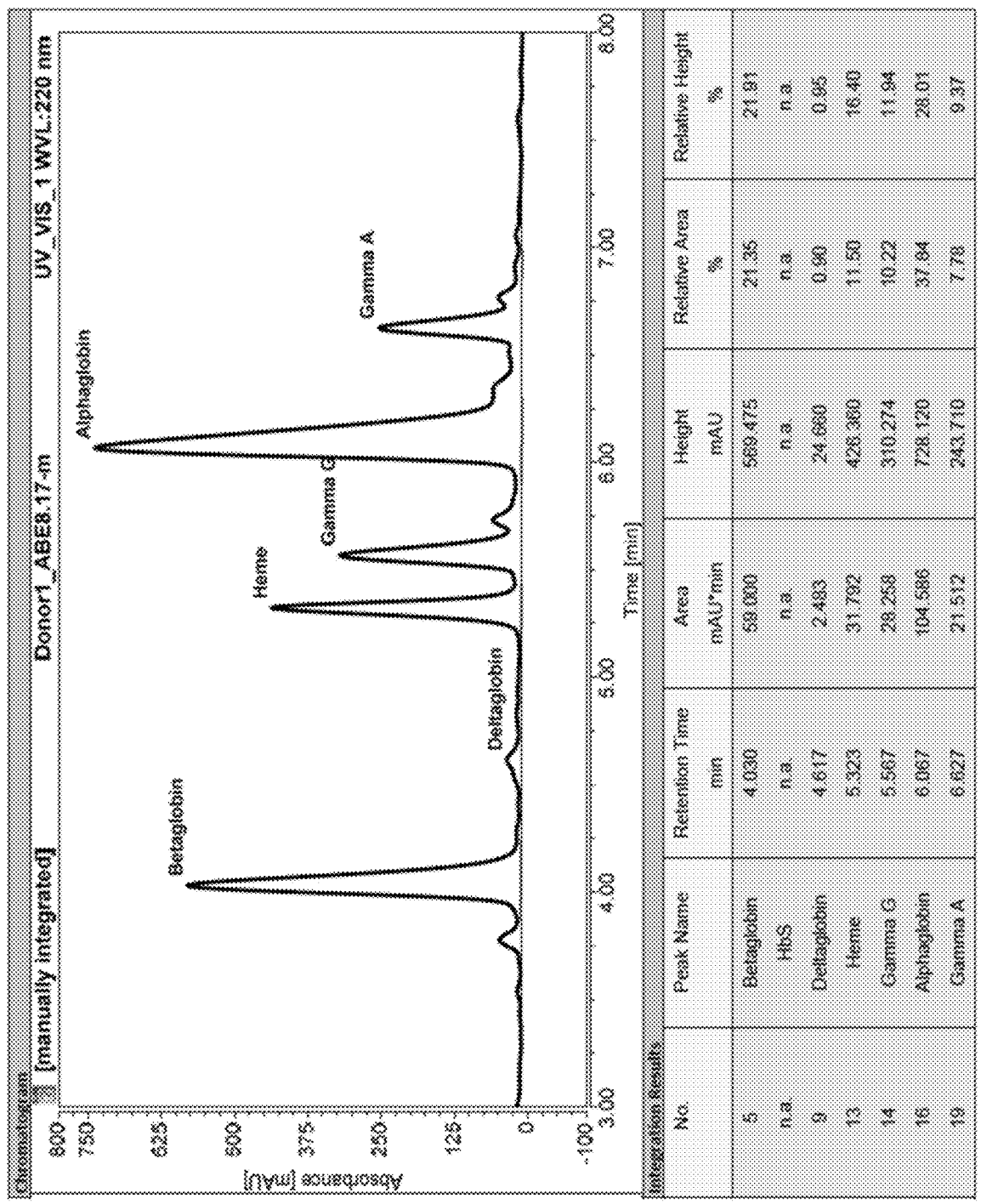
Figure 49:
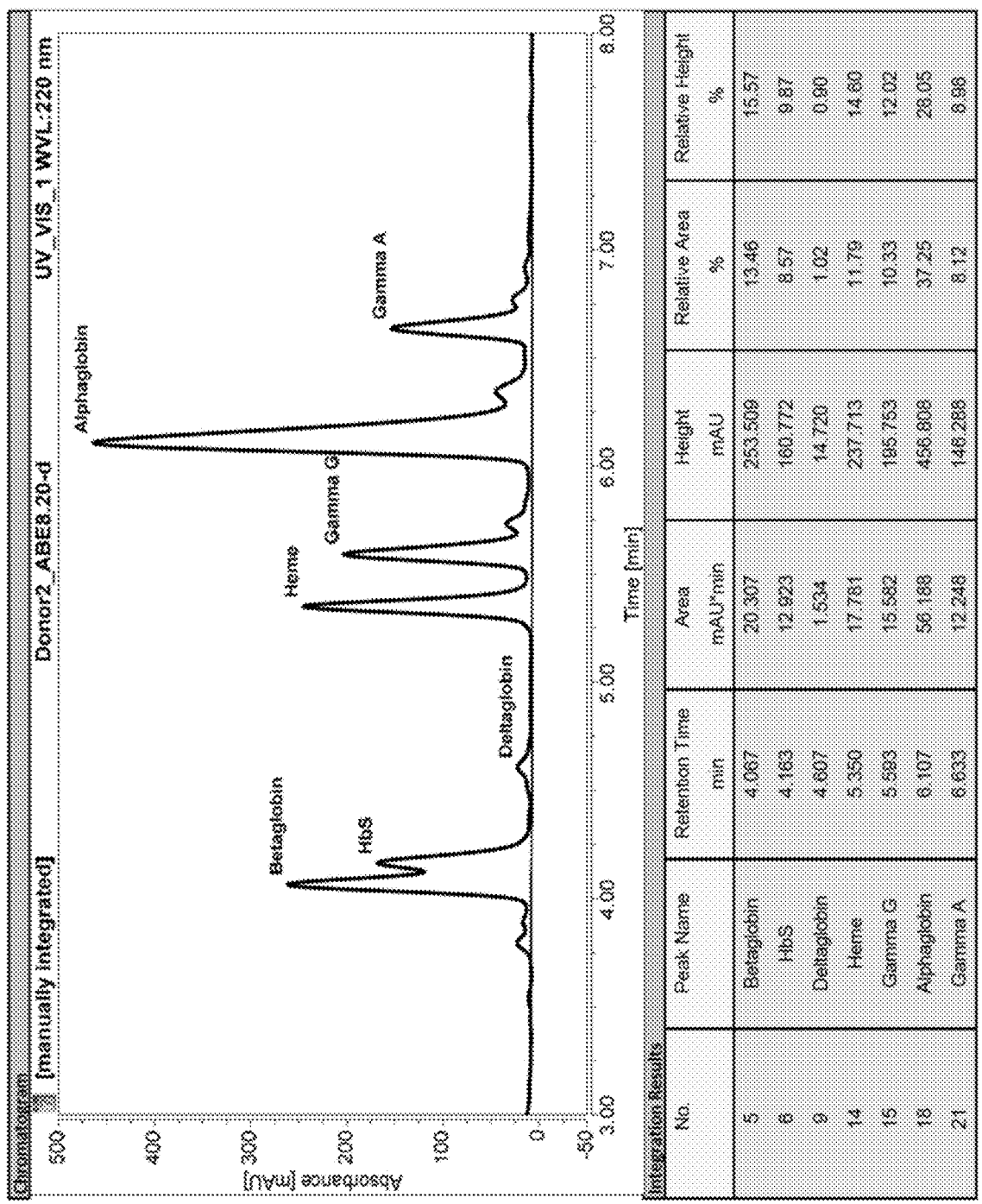
FIG. 49 depicts an UHPLC UV-Vis trace (220 nm) and integration of globin chain levels of differentiated CD34+ cells treated with ABE8.20-d (donor 2). Note: donor 2 is heterozygous for sickle cell disease.
Figure 50:
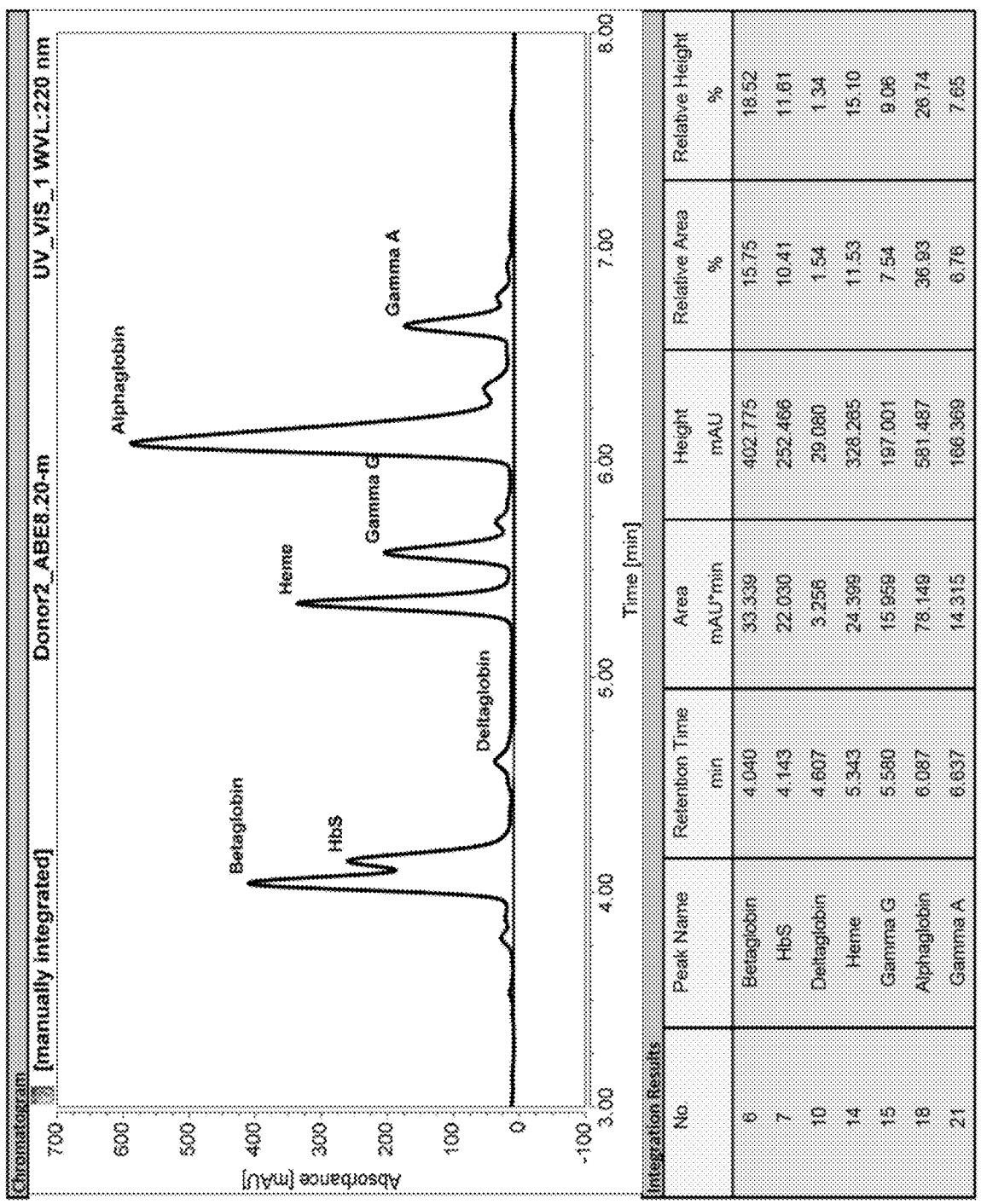
FIG. 50 depicts an UHPLC UV-Vis trace (220 nm) and integration of globin chain levels of differentiated CD34+ cells treated with ABE8.20-m (donor 2). Note: donor 2 is heterozygous for sickle cell disease.
Figures 51A, 51B:
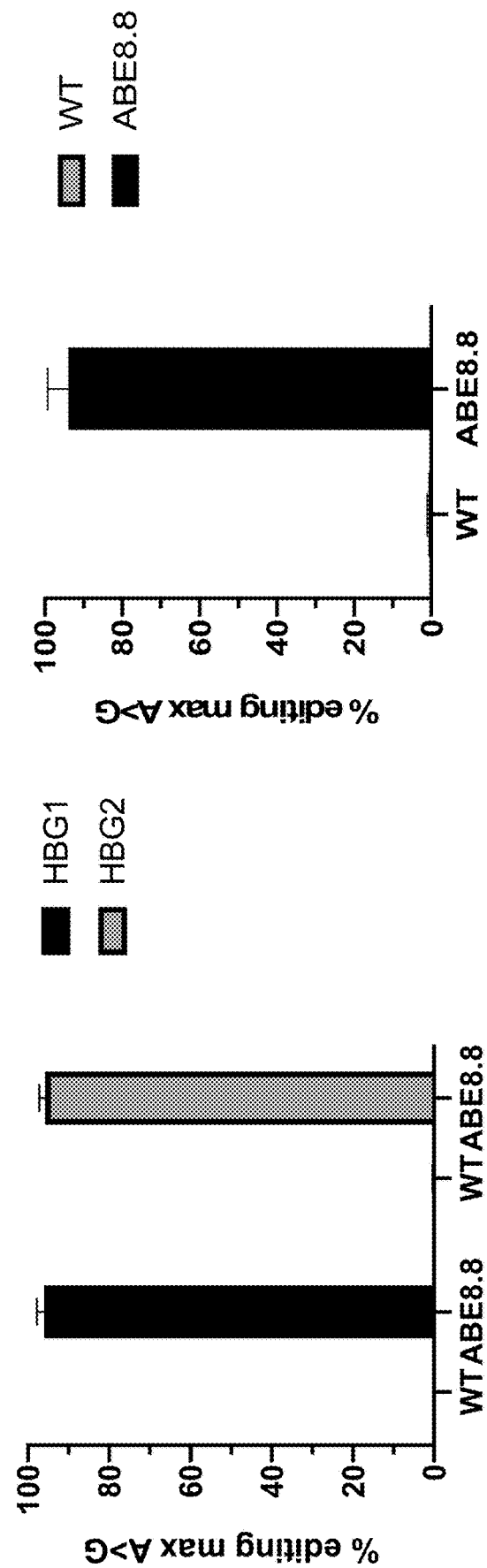
FIG. 51A-51E depict editing with ABE8.8 at two independent sites reached over 90% editing on day 11 post erythroid differentiation before enucleation and about 60% of gamma globin over alpha globin or total beta family globin on day 18 post erythroid differentiation.
Figures 51C, 51D, 51E:
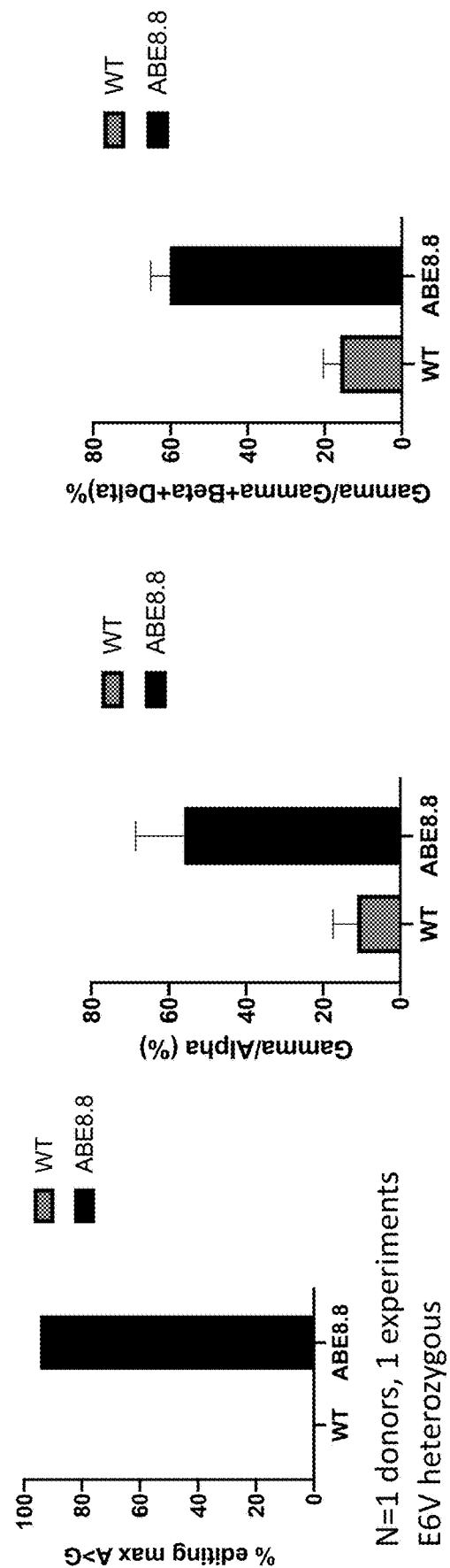

Next, the amount of γ-globin protein produced following ABE treatment and erythrocyte differentiation was quantified by UPLC (FIGS. 30-50). A 3.5-fold average increase in % γ-globin/α-globin expression in erythrocytes derived from the ABE8 treatment groups was observed when compared to mock treated cells and about a 1.4-fold increase when comparing ABE8.13-d to levels achieved with ABE7.10-m/d (FIG. 27C). At least about ≥20% HbF-expressing cells are required to ameliorate symptoms of sickle cell disease and β-thalassemia patients likely require even higher minimum levels (see e.g., Canver, M. C. & Orkin, S. H. Customizing the genome as therapy for the beta-hemoglobinopathies. Blood 127, 2536-2545, doi:10.1182/blood-2016-01-678128 (2016); Fitzhugh, C. D. et al. At least 20% donor myeloid chimerism is necessary to reverse the sickle phenotype after allogeneic HSCT. Blood 130, 1946-1948, doi:10.1182/blood-2017-03-772392 (2017)). The γ-globin levels observed following ABE8 editing are consistent with HbF levels higher than these thresholds and greater than levels achieved with ABE7.10.

Overall, ABE8s recreated a naturally occurring hereditary persistence of fetal hemoglobin (HPFH) allele at the promoter of the γ-globin genes HBG1 and HBG2 (see FIG. 27A), achieving editing efficiencies of up to 60% in human CD34+ cell cultures and a corresponding upregulation of gamma globin expression in differentiated erythrocytes.

Example 6: Complementary Base Editing Approaches for the Treatment of Sickle Cell Disease and Beta Thalassemia Sickle cell disease (SCD) and Beta thalassemia are disorders of beta globin production and function that lead to severe anemia and significant disease complications across a multitude of organ systems. Autologous transplantation of hematopoietic stem cells engineered through the upregulation of fetal hemoglobin (HbF) or correction of the beta globin gene have the potential to reduce disease burden in patients with beta hemoglobinopathies. Base editing is a recently developed technology that enables precise modification of the genome without the introduction of double strand DNA breaks.

Gamma globin gene promoters were comprehensively screened with cytosine and adenine base editors (ABE) for the identification of alterations that would derepress HbF. Three regions were identified that significantly upregulated HbF, and the most effective nucleotide residue conversions are supported by natural variation seen in patients with hereditary persistence of fetal hemoglobin (HPFH). ABEs have been developed that significantly increase the level of HbF following nucleotide conversion at key regulatory motifs within the HBG1 and HBG2 promoters. CD34+ hematopoietic stem and progenitor cells (HSPC) were purified at clinical scale and edited using a process designed to preserve self-renewal capacity. Editing at two independent sites with different ABEs reached 94 percent and resulted in up to 63 percent gamma globin by UPLC (FIGS. 51A-51E). The levels of HbF observed should afford protection to the majority of SCD and Beta thalassemia patients based on clinical observations of HPFH and non-interventional therapy that links higher HbF dosage with milder disease (Ngo et al., 2011 Brit J Hem; Musallam et al., 2012 Blood).

Figure 52A:
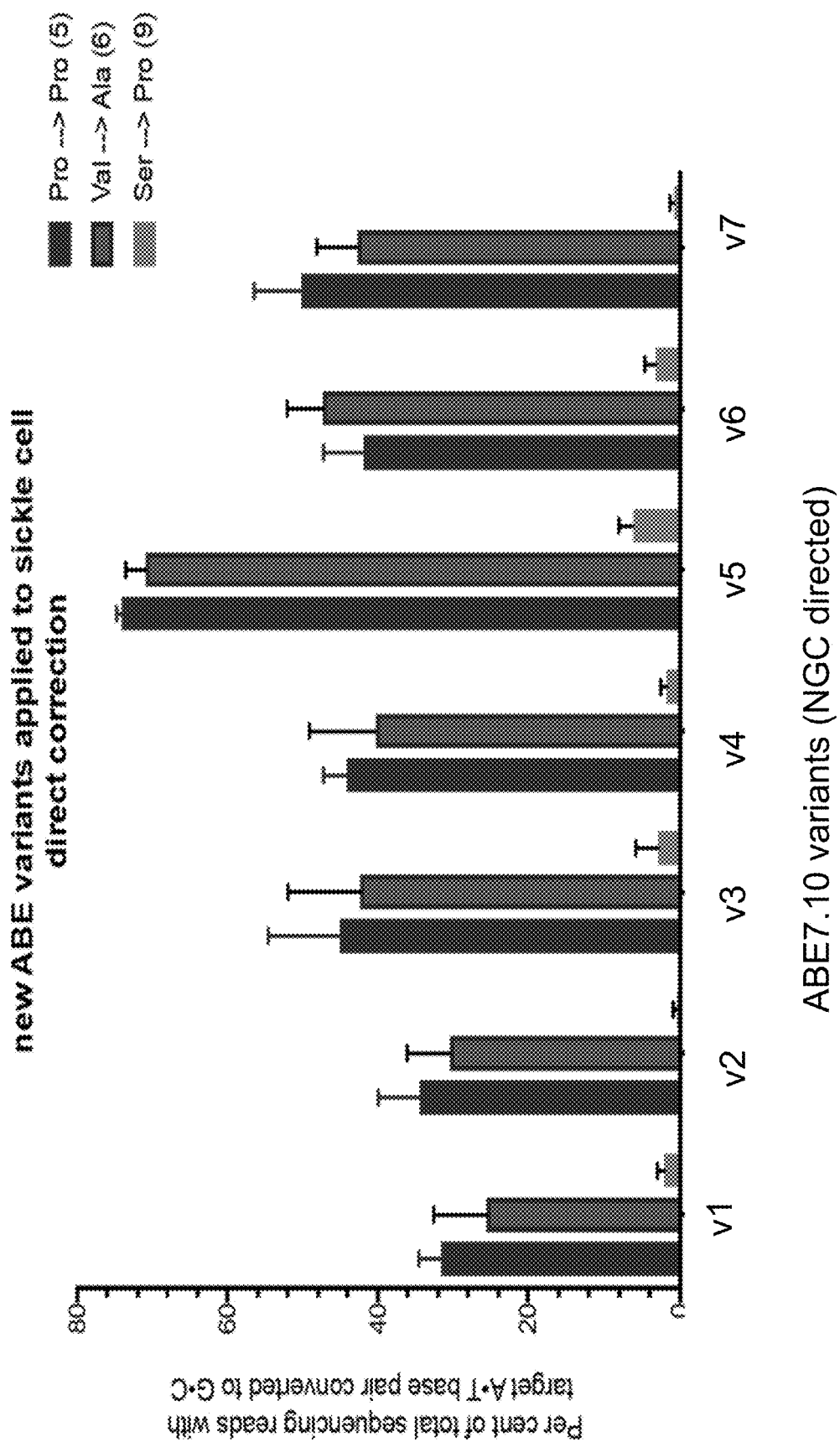
FIGS. 52A and 52B depict percent editing using ABE variants to correct sickle cell mutations.
Figure 52B:
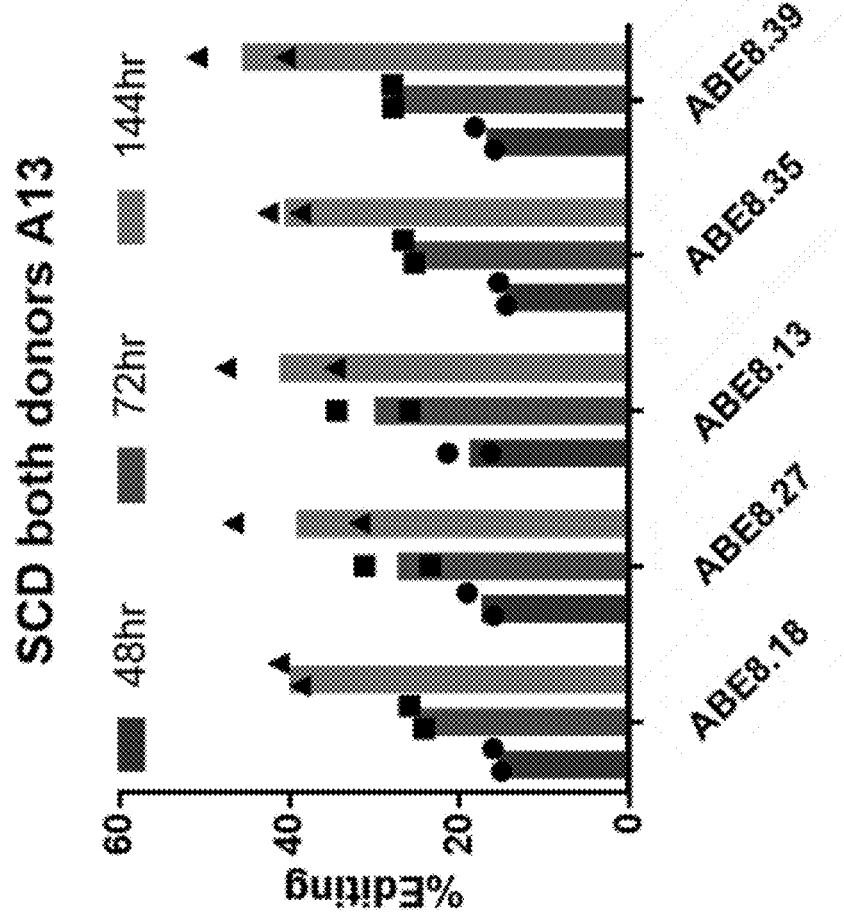

Directly correcting the Glu6Val mutation of SCD has been a recent goal of genetic therapies designed for the SCD population. Current base editing technology cannot yet convert mutations like those that result from the A-T transversion in sickle beta globin; however, ABE variants have been designed to recognize and edit the opposite stranded adenine residue of valine. This results in the conversion of valine to alanine and the production of a naturally occurring variant known as Hb G-Makassar. Beta globin with alanine at this position does not contribute to polymer formation, and patients with Hb G-Makassar present with normal hematological parameters and red blood cell morphology. SCD patient fibroblasts edited with these ABE variants achieve up to 70 percent conversion of the target adenine (FIG. 52A). CD34 cells from healthy donors were then edited with a lead ABE variant, targeting a synonymous mutation in an adjacent proline that resides within the editing window and serves as a proxy for editing the SCD mutation. The average editing frequency was 40 percent (FIG. 52B). Donor myeloid chimerism documented at these levels in the allogeneic transplant setting exceeds the 20 percent that is required for reversing the sickle phenotype (Fitzhugh et al, 2017 Blood).

Example 7: Whole Genome Sequencing

Whole genome sequencing (WGS) was performed (FIG. 56) to assess the degree to which ABE8s may induce genome-wide point mutations in a sgRNA-independent manner (referred to here as 'spurious deamination') as has been previously reported for CBEs, but not ABE7.10 or Cas9 (Jin, S. et al. Cytosine, but not adenine, base editors induce genome-wide off-target mutations in rice. Science 364, 292-295, doi:10.1126/science.aaw7166 (2019); Zuo, E. et al. Cytosine base editor generates substantial off-target single-nucleotide variants in mouse embryos. Science 364, 289-292, doi:10.1126/science.aav9973 (2019); Lee, H. K., et al. Cytosine base editor 4 but not adenine base editor generates off-target mutations in mouse embryos. Commun Biol 3, 19, doi:10.1038/s42003-019-0745-3 (2020); McGrath, E. et al. Targeting specificity of APOBEC-based cytosine base editor in human iPSCs determined by whole genome sequencing. Nat Commun 10, 5353, doi:10.1038/s41467-019-13342-8 (2019)). Accordingly, HEK293T cells were transfected with base editor-encoding mRNA and sgRNA targeting B2M (Site 21) (FIG. 56). After seventy-two hours of incubation, fluorescence activated cell sorting (FACS) was used to isolate B2M-negative single cells that had been successfully base edited (FIG. 56). Single-sorted cells were individually clonally expanded to generate sufficient genomic DNA to perform Illumina-based whole genome sequencing. All treated samples were confirmed to be bi-allelically edited at the on-target B2M locus, indicating receipt of active base editor or Cas9.

Consistent with previous results from ABE7.10-d-treated animals in embryo injection mouse experiments (Jin, S. et al. Cytosine, but not adenine, base editors induce genome-wide off-target mutations in rice. Science 364, 292-295, doi: 10.1126/science.aaw7166 (2019); Zuo, E. et al. Cytosine base editor generates substantial off-target single-nucleotide variants in mouse embryos. Science 364, 289-292, doi: 10.1126/science.aav9973 (2019); Lee, H. K., et al. Cytosine base editor 4 but not adenine base editor generates off-target mutations in mouse embryos. Commun Biol 3, 19, doi: 10.1038/s42003-019-0745-3 (2020); McGrath, E. et al. Targeting specificity of APOBEC-based cytosine base editor in human iPSCs determined by whole genome sequencing. Nat Commun 10, 5353, doi:10.1038/s41467-019-13342-8 (2019)), no detectable increase (P-value=0.911, one-sided Wilcoxon-Mann-Whitney U test, Table 16) was found in genome-wide A-to-G mutations upon treatment with ABE7.10-d (FIG. 57 and FIG. 58). Concurrently, a statistically significant increase was found in C-to-T mutations in BE4-treated samples compared to untreated controls (P-value=0.010, one-sided Wilcoxon-Mann-Whitney U test, Table 16), consistent with previous reports (Jin, S. et al. Cytosine, but not adenine, base editors induce genome-wide off-target mutations in rice. Science 364, 292-295, doi: 10.1126/science.aaw7166 (2019); Zuo, E. et al. Cytosine base editor generates substantial off-target single-nucleotide variants in mouse embryos. Science 364, 289-292, doi: 10.1126/science.aav9973 (2019); Lee, H. K., et al. Cytosine base editor 4 but not adenine base editor generates off-target mutations in mouse embryos. Commun Biol 3, 19, doi: 10.1038/s42003-019-0745-3 (2020); McGrath, E. et al. Targeting specificity of APOBEC-based cytosine base editor in human iPSCs determined by whole genome sequencing. Nat Commun 10, 5353, doi:10.1038/s41467-019-13342-8 (2019)). No statistically significant increase was observed in A→G % mutation rates across the ABE8.17-m, ABE8.20-m or Cas9 groups when compared to untreated samples (P-value=0.375, 0.643, and 0.27, respectively, one-sided Wilcoxon-Mann-Whitney U test, FIG. 57, FIG. 58, Table 16). However, individual samples in most treatment groups exhibited substantially higher or lower relative rates of A-to-G or C-to-T mutations, including a sample with elevated A-to-G mutation rates in the Cas9-treated group.

To generate whole genome sequencing data from ABE7.10-d, ABE8.20-m, ABE8.17-m, Cas9 and BE4-treated cells, genomic DNA was sequenced from five (BE4, Cas9, no treatment, ABE7.10-d and ABE8.20-m) or six (ABE8.17-m) single cell HEK293T cell clones with >20× coverage of the genome. As described in Example 8, the mutational profiles for each sample were calculated relative to one no treatment sample, referred to as the background control, and are displayed in FIG. 57 along with the absolute number of relative mutations (Table 17).

To determine whether base editor treatment leads to a detectable level of unguided spurious DNA deamination, the highly transformed cell line HEK293T was used, assuming a high degree of chromatin accessibility. As such, this system was used to compare the relative rates of mutations rather than rely on the absolute numbers as a reflection of true mutation rates. In these experiments, it was calculated whether each sample displayed a statistically significant (Fisher's Exact Test, FIG. 58) increase or decrease in C-to-T mutation relative to the background control (in the case of BE4) or A-to-G (in the case of ABE and Cas9-treated samples). Consistent with prior work (see e.g., Rees, H. A., Wilson, C., Doman, J. L. & Liu, D. R. Analysis and minimization of cellular RNA editing by DNA adenine base editors. Sci Adv 5, eaax5717, doi:10.1126/sciadv.aax5717 (2019); Grunewald, J. et al. Transcriptome-wide off-target RNA editing induced by CRISPR-guided DNA base editors. Nature 569, 433-437, doi:10.1038/s41586-019-1161-z (2019); Grunewald, J. et al. CRISPR DNA base editors with reduced RNA off-target and self-editing activities. Nat Biotechnol 37, 1041-1048, doi:10.1038/s41587-019-0236-6 (2019); Zhou, C. et al. Off-target RNA mutation induced by DNA base editing and its elimination by mutagenesis. Nature 571, 275-278, doi:10.1038/s41586-019-1314-0 (2019)), this analysis confirmed that 5/5 BE4 clones displayed a significant increase in genome-wide C-to-T mutation (denoted with  in FIG. 57), and that 0/5 ABE7.10-d, 0/4 no treatment, 1/6 ABE8.17-m, 2/5 ABE8.20-m and 1/5 Cas9-treated clones display an increase in A-to-G mutation (denoted with  in FIG. 57). The Cas9-treated sample with an increased number of A-to-G mutations relative to the background control shows a greatly increased number of detected mutations (9,532) when compared to the rest of the sequence samples; the 29 remaining samples fell in the range 3,043-6,056. 1/5 ABE8.20-m-treated clones displayed a significant reduction (denoted with * in FIG. 57) in the frequency of genome-wide A-to-G mutation. Together with the Cas9-treated sample showing a statistically significant increase in A-to-G mutation, these two unexpected data points indicates that there may be variability between cells, which could be caused by a pre-existing genetic variation within the initial group of HEK293T cells that were transfected with mRNA. For this reason, the data is expressed as a median rather than mean to mitigate the impact of possible outliers in the dataset.

The protocol employed (see Example 8) was adapted to not use HEK293T cells grown from a single cell clone (see McGrath, E. et al. Targeting specificity of APOBEC-based cytosine base editor in human iPSCs determined by whole genome sequencing. Nat Commun 10, 5353, doi:10.1038/s41467-019-13342-8 (2019)); instead, a sample of HEK293T cells obtained from ATCC was used and maintained in culture for approximately 4 weeks prior to transfection.

An analysis was performed of the statistical significance of differences in deamination frequencies of cytosine or adenine residues between treatment groups, using the Mann-Whitney U test (Table 16). The only group with significant editing of this type (relative to the untreated control group) is the BE4 treatment group, which shows a significant (p=0.018) increase in C:G-to-T:A (or G:C-to-A:T) mutations relative to the untreated control. This assay suggests that the ABE base editors tested here do not cause spurious deamination in the genome on a comparable level to BE4. However, it is possible that cellular heterogeneity or some other experimental limitation may cause false positive or negative results.

Overall, these results indicate that treatment with ABE7 or ABE8 does not lead to substantially elevated mutation rates as observed for CBEs, such as BE3 and BE4. These findings further characterize the DNA specificity of ABEs and are encouraging both for their use as research tools and in therapeutic applications.

TABLE 16

P-values resulting from comparisons between relative cytosine and adenine deamination-induced mutation frequencies amongst treatment groups subjected to whole genome sequencing

| Treatment | ODDS RATIO | | % | |
| --- | --- | --- | --- | --- |
| | A->G | C->T | A->G | C->T |
| BE4 | 0.991 | 0.018 | 0.995 | 0.010 |
| ABE7.10-d | 0.883 | 0.883 | 0.911 | 0.944 |
| ABE8.17-m | 0.259 | 0.817 | 0.375 | 0.880 |

TABLE 16-continued

P-values resulting from comparisons between relative cytosine and adenine deamination-induced mutation frequencies amongst treatment groups subjected to whole genome sequencing

| Treatment | ODDS RATIO | | % | |
| --- | --- | --- | --- | --- |
| | A->G | C->T | A->G | C->T |
| ABE8.20-m | 0.617 | 0.725 | 0.643 | 0.804 |
| Cas9 | 0.275 | 0.383 | 0.270 | 0.643 |
| No Treatment | 0.590 | 0.590 | 0.559 | 0.559 |

TABLE 17

Total number of mutations, relative to untreated control, detected in each whole genome sequencing sample

| Sample ID | Treatment | Number of mutations relative to no treatment control |
| --- | --- | --- |
| H17 | ABE7.10-d | 3386 |
| H18 | ABE7.10-d | 3260 |
| H19 | ABE7.10-d | 3237 |
| H21 | ABE7.10-d | 3357 |
| H23 | ABE7.10-d | 3097 |
| H10 | ABE8.17-m | 3558 |
| H12 | ABE8.17-m | 3761 |
| H13 | ABE8.17-m | 3043 |
| H15 | ABE8.17-m | 3623 |
| H16 | ABE8.17-m | 2595 |
| H9 | ABE8.17-m | 3539 |
| H25 | ABE8.20-m | 5101 |
| H26 | ABE8.20-m | 4163 |
| H27 | ABE8.20-m | 2598 |
| H28 | ABE8.20-m | 2996 |
| H29 | ABE8.20-m | 3035 |
| H1 | BE4 | 5947 |
| H3 | BE4 | 6056 |
| H4 | BE4 | 6024 |
| H7 | BE4 | 5394 |
| H8 | BE4 | 5180 |
| H33 | Cas9 | 9532 |
| H34 | Cas9 | 3329 |
| H35 | Cas9 | 3224 |
| H36 | Cas9 | 3872 |
| H37 | Cas9 | 3807 |
| H44 | No Treatment | 3145 |
| H45 | No Treatment | 3659 |
| H46 | No Treatment | 3532 |
| H47 | No Treatment | 3786 |

Example 8: Materials and Methods

General Methods:

All cloning was conducted via USER enzyme (New England Biolabs) cloning methods (see Geu-Flores et al., USER fusion: a rapid and efficient method for simultaneous fusion and cloning of multiple PCR products. *Nucleic Acids Res* 35, e55, doi:10.1093/nar/gkm106 (2007)) and templates for PCR amplification were purchased as bacterial or mammalian codon optimized gene fragments (GeneArt). Vectors created were transformed into Mach T1$^R$ Competent Cells (Thermo Fisher Scientific) and maintained at −80° C. for long-term storage. All primers used in this work were purchased from Integrated DNA Technologies and PCRS were carried out using either Phusion U DNA Polymerase Green MultiPlex PCR Master Mix (ThermoFisher) or Q5 Hot Start High-Fidelity 2× Master Mix (New England Biolabs). All plasmids used in this work were freshly prepared from 50 mL of Machi culture using ZymoPURE Plasmid Midiprep (Zymo Research Corporation) which involves an endotoxin removal procedure. Molecular biology grade, Hyclone water (GE Healthcare Life Sciences) was used in all assays, transfections, and PCR reactions to ensure exclusion of DNAse activity.

Amino acid sequences of sgRNAs used for Hek293T mammalian cell transfection are provided in Table 18 below. The 20-nt target protospacer is shown in bold font. When a target DNA sequence did not start with a 'G,' a 'G' was added to the 5' end of the primer since it has been established that the human U6 promoter prefers a 'G' at the transcription start site (see Cong, L. et al., Multiplex genome engineering using CRISPR/Cas systems. Science 339, 819-823, doi: 10.1126/science.1231143 (2013)). The pFYF sgRNA plasmid described previously was used as a template for PCR amplification.

TABLE 18

Sequences of sgRNAs used for Hek293T mammalian cell transfection.

| Site | RNA spacer sequence | Cas9 scaffold | PAM |
| --- | --- | --- | --- |
| 1 | GAACACAAAGCAUAGACUGC (SEQ ID NO: 256) | S. pyogenes | NGG |
| 2 | GGGAAAGACCCAGCAUCCGU (SEQ ID NO: 257) | S. pyogenes | NGG |
| 3 | GCUCCCAUCACAUCAACCGG (SEQ ID NO: 258) | S. pyogenes | NGG |
| 4 | GGUGAGUGAGUGUGUGCGUG (SEQ ID NO: 259) | S. pyogenes | NGG |
| 5 | GGCUUCAGGUUCUAAAUGAG (SEQ ID NO: 260) | S. pyogenes | NGG |
| 6 | GCAGAGAGUCGCCGUCUCCA (SEQ ID NO: 261) | S. pyogenes | NGG |

TABLE 18-continued

Sequences of sgRNAs used for Hek293T mammalian cell transfection.

| Site | RNA spacer sequence | Cas9 scaffold | PAM |
|------|---------------------|---------------|-----|
| 7 | GUGUAAGACCUCAAAAGCAC (SEQ ID NO: 262) | S. pyogenes | NGG |
| 8 | GAUGAGAAGGAGAAGUUCUU (SEQ ID NO: 263) | S. pyogenes | NGG |
| 9 | GAGGACAAAGUACAAACGGC (SEQ ID NO: 264) | S. pyogenes | AGA |
| 10 | GCCACCACAGGGAAGCUGGG (SEQ ID NO: 265) | S. pyogenes | TGA |
| 11 | GCUCUCAGGCCCUGUCCGCA (SEQ ID NO: 266) | S. pyogenes | CGT |
| 12 | GAGCAAAUACCAGAGAUAAG (SEQ ID NO: 267) | S. pyogenes | AGA |
| 13 | GAUCAGGAAAUAGAGCCACA (SEQ ID NO: 268) | S. pyogenes | GGC |
| 14 | GCCCAUCCCUGAGUCCAGCG (SEQ ID NO: 269) | S. pyogenes | AGC |
| 15 | GAACACGAAGACAUCUGAAGGUA (SEQ ID NO: 270) | S. aureus | TTGAAT |
| 16 | GAUUUACAGCCUGGCCUUUGGGG (SEQ ID NO: 271) | S. aureus | TCGGGT |
| 17 | GGAGAGAAAGAGAAGUUGAUUG (SEQ ID NO: 272) | S. aureus | ATGGGT |
| 18 | GAGGGUGAGGGAUGAGAUAAUG (SEQ ID NO: 273) | S. aureus | ATGAGT |
| 19 | GGUGGAGGAGGGUGCAUGGGGU (SEQ ID NO: 274) | S. aureus | CAGAAT |
| 20 | GCUGUUGCAUGAGGAAAGGGAC (SEQ ID NO: 275) | S. aureus | TAGAGT |
| HEK2 | GAACACAAAGCAUAGACUGC (SEQ ID NO: 256) | S. pyogenes | CGG |
| HEK3 | GGCCCAGACUGAGCACGUGA (SEQ ID NO: 276) | S. pyogenes | TGG |
| HEK4 | GGCACUGCGGCUGGAGGUGG (SEQ ID NO: 277) | S. pyogenes | GGG |
| LDLR | GCAGAGCACUGGAAUUCGUCA (SEQ ID NO: 278) | S. pyogenes | GGG | sgRNA scaffold sequences are as follows:

S. pyogenes:
GUUUUAGAGCUAGAAAUAGCAAGUUAAAAUAAGGCUAGUCCGUUAUCAACUUGAAAAAGUGGCACCGAGUCGGUGC (SEQ ID NO: 279)

S. aureus:
GUUUUAGUACUCUGUAAUGAAAAUUACAGAAUCUACUAAAACAAGGCAAAAUGCCGUGUUUAUCUCGUCAACUUGUUGGCGAGA (SEQ ID NO: 280)

Generation of Input Bacterial TadA* Libraries for Directed Evolution

The TadA*8.0 library was designed to encode all 20 amino acids at each amino acid position in the TadA*7.10 open reading frame (Gaudelli, N. M. et al., Programmable base editing of A*T to G*C in genomic DNA without DNA cleavage. Nature 551, 464-471, doi:10.1038/nature24644 (2017)). Each TadA*8.0 library member contained about 1-2 new coding mutations and was chemically synthesized and purchased from Ranomics Inc (Toronto, Canada). The TadA*8.0 library was PCR amplified with Phusion U Green MultiPlex PCR Master Mix and USER-assembled into a bacterial vector optimized for ABE directed evolution (Gaudelli, N. M. et al., Programmable base editing of A*T to G*C in genomic DNA without DNA cleavage. Nature 551, 464-471, doi:10.1038/nature24644 (2017)).

Bacterial Evolution of TadA Variants

Directed evolution of ABE containing the TadA*8 library was conducted as previously described (Gaudelli, N. M. et al., Programmable base editing of A*T to G*C in genomic DNA without DNA cleavage. Nature 551, 464-471, doi: 10.1038/nature24644 (2017)) with the following changes: i) E. coli 10 betas (New England Biolabs) were used as the evolution host; and ii) survival on kanamycin relied on correction of three genetic inactivating components (e.g. survival required reversion of two stop mutations and one active site mutation in kanamycin). The kanamycin resistance gene sequence (below) contains selection mutations for ABE8 evolution. After overnight co-culturing of selection plasmid and editor in 10 beta host cells, the library cultures were plated on 2×YT-agar medium supplemented with plasmid maintenance antibiotic and increasing concentrations of selection antibiotic, kanamycin (64-512 µg/mL). Bacteria were allowed to grow for 1 day and the TadA*8 portion of the surviving clones were Sanger sequenced after enrichment. Identified TadA*8 mutations of interest were then were then incorporated into mammalian expression vector via USER assembly.

In the following sequence, lower case denotes the kanamycin resistance promoter region, bold sequence indicates targeted inactivation portion (Q4* and W15*), the italicized sequence denotes the targeted inactive site of kanamycin resistance gene (D208N), and the underlined sequences denote the PAM sequences.

```
Inactivated kanamycin resistance gene:
ccggaattgccagctggggcgccctctggtaaggttgggaagccctgca aagtaaactggatggctttcttgccgccaaggatctgatggcgcagggg atcaagatctgatcaagagacaggatgaggatccttTcgcATGATCGAA

TAAGATGGATTGCACGCAGGTTCTCCGGCCGCTTAGGTGGAGCGCCTAT

TCGGCTATGACTGGGCACAACAGACAATCGGCTGCTCTGATGCCGCCGT

GTTCCGGCTGTCAGCGCAGGGGCGCCCGGTTCTTTTTGTCAAGACCGAC

CTGTCCGGTGCCCTGAATGAACTGCAGGACGAGGCAGCGCGGCTATCGT

GGCTGGCCACGACGGGCGTTCCTTGCGCAGCTGTGCTCGACGTTGTCAC

TGAAGCGGGAAGGGACTGGCTGCTATTGGGCGAAGTGCCGGGGCAGGAT

CTCCTGTCATCTCACCTTGCTCCTGCCGAGAAAGTATCCATCATGGCTG

ATGCAATGCGGCGGCTGCATACGCTTGATCCGGCTACCTGCCCATTCGA

CCACCAAGCGAAACATCGCATCGAGCGAGCACGTACTCGGATGGAAGCC

GGTCTTGTCGATCAGGATGATCTGGACGAAGAGCATCAGGGGCTCGCGC

CAGCCGAACTGTTCGCCAGGCTCAAGGCGCGCATGCCCGACGGCGAGGA

TCTCGTCGTGACCCATGGCGATGCCTGCTTGCCGAATATCATGGTGGAA

AATGGCCGCTTTTCTGGATTCATTAACTGTGGCCGGCTGGGTGTGGCGG

ACCGCTATCAGGACATAGCGTTGGCTACCCGTGATATTGCTGAAGAGCT

TGGCGGCGAATGGGCTGACCGCTTCCTCGTGCTTTACGGTATCGCCGCT

CCCGATTCGCAGCGCATCGCCTTCTATCGCCTTCTTGACGAGTTCTTCT

AA (SEQ ID NO: 255)
```

General HEK293T and RPMI-8226 Mammalian Culture Conditions

Cells were cultured at 37° C. with 5% $CO_2$. HEK293T cells [CLBTx013, American Type Cell Culture Collection (ATCC)] were cultured in Dulbecco's modified Eagles medium plus Glutamax (10566-016, Thermo Fisher Scientific) with 10% (v/v) fetal bovine serum (A31606-02, Thermo Fisher Scientific). RPMI-8226 (CCL-155, ATCC) cells were cultured in RPMI-1640 medium (Gibco) with 10% (v/v) fetal bovine serum (Gibco). Cells were tested negative for *Mycoplasma* after receipt from supplier.

Hek293T Plasmid Transfection and gDNA Extraction

HEK293T cells were seeded onto 48-well well Poly-D-Lysine treated BioCoat plates (Corning) at a density of 35,000 cells/well and transfected 18-24 hours after plating. Cells were counted using a NucleoCounter NC-200 (Chemometec). To these cells were added 750 ng of base editor or nuclease control, 250 ng of sgRNA, and 10 ng of GFP-max plasmid (Lonza) diluted to 12.5 µL total volume in Opti-MEM reduced serum media (ThermoFisher Scientific). The solution was combined with 1.5 µL of Lipofectamine 2000 (ThermoFisher) in 11 µL of Opti-MEM reduced serum media and left to rest at room temperature for 15 min. The entire 25 µL mixture was then transferred to the pre-seeded Hek293T cells and left to incubate for about 120 h. Following incubation, media was aspirated and cells were washed two times with 250 µL of 1×PBS solution (ThermoFisher Scientific) and 100 µL of freshly prepared lysis buffer was added (100 mM Tris-HCl, pH 7.0, 0.05% SDS, 25 µg/mL Proteinase K (Thermo Fisher Scientific). Transfection plates containing lysis buffer were incubated at 37° C. for 1 hour and the mixture was transferred to a 96-well PCR plate and heated at 80° C. for 30 min.

Hek293T mRNA Lipofection

HEK293T cells were plated on 48-well poly-D-lysine coated plates (Corning) 16 to 20 hours before lipofection at a density of 30,000 cells per well in DMEM+Glutamax medium (Thermo Fisher Scientific) without antibiotics. 500 ng Cas9 or base editor expression mRNA was combined with 100 ng of chemically modified synthetic sgRNA (2'-O-methyl analogs and 3' phosphorothioate linkages at the first three 5' and final three 3' terminal RNA residues, Synthego) into a total volume of 15 µl with OPTIMEM+Glutamax. This was combined with 10 µl of lipid mixture, comprising 1.0 µl Lipofectamine MessengerMax and 9.0 µl OPTIMEM+Glutamax per well. Cells were harvested 3 days after transfection and either DNA or RNA was harvested and processed as described below.

Treatment of HEK293T Cells for Whole Genome Sequencing, Including Preparation of Genomic DNA and Clonal Isolation of Edited Cells Cells were lipofected with base editor or Cas9-encoding mRNA combined an sgRNA targeting a region in B2M, which, when successfully targeted by ABE, CBE or Cas9 leads to disruption of B2M (sgRNA target sequence: 5'-CT-TACCCCACTTAACTATCT-3' (SEQ ID NO: 281), Synthego) (Qasim, W. et al. Molecular remission of infant B-ALL after infusion of universal TALEN gene-edited CAR T cells. Sci Transl Med 9, doi:10.1126/scitranslmed.aaj2013 (2017)) either through splice site disruption (ABE, Cas9) or incorporation of a stop codon (CBE), as described herein. 24 hours post-transfection, cells were split 3:8 into a new plate to encourage cell growth. Three days post-transfection, HEK293T cells were harvested with TrypIE Express (ThermoFisher), washed 1× with FACS buffer (PBS, 1% BSA, both ThermoFisher) and chilled at 4° C. for 15 minutes. The cells were then pelleted (1500 *g, 5 mins) and resuspended in a solution of FACS buffer with a 1:100 dilution of PE anti-human B2-microglobin (Biolegend 316306). Cells were incubated for 30 mins in the dark at 4° C. Cells were then washed 3 times with FACS buffer by centrifugation (1500 *g, 5 mins) and resuspended in FACS buffer. Single, B2M-negative cells were sorted into 96-well plates except from untreated cells for which B2M-positive cells were sorted into 96-well plates. Representative FACS plots are shown in FIGS. 59A and 59B. Nine days post sorting, wells were inspected and those containing single colonies were marked and treated with TrypIE Express to promote cell growth. After four days of additional growth, genomic DNA was harvested from cells using Agincourt DNAdvance kit (Beckmann Coulter), according to the manufacturer's instructions.

Genomic DNA was fragmented and adapter-ligated using the Nextera DNA Flex Library Prep Kit (Illumina) using the 96-well plate Nextera indexing primers (Illumina), according to the manufacturer's instructions. Library size and concentration was confirmed by Fragment Analyzer (Agilent) and sent to Novogene for whole genome sequencing using an Illumina HiSeq.

Analysis of Whole Transcriptome and Whole Genome Sequencing Data

All targeted NGS data were analyzed by performing four general steps: (1) alignment, (2) duplicate marking, (3) variant calling (4) background filtration of variants to remove artifacts and germline mutations. Each step is described below. The mutation reference and alternate alleles are reported relative to the plus strand of the reference genome.

Whole Transcriptome Analysis Details
1. Lane level FASTQ files were separately aligned to the human genome (Gencode GRCh38v31 primary assembly) using STAR (v2.7.2a) with parameters set to specify the ReadGroup and output both a genome aligned BAM file and a transcriptome aligned BAM file.
2. Lane level genome alignments for each sample created in step (1) were merged, sorted by coordinate, and duplicate marked using Picard (v2.20.5).
3. Reads containing Ns in their cigar string because they span splicing junctions were split using GATK (v4.1.3.0) SplitNCigarReads.
4. Base quality scores were recalibrated using Picard with default settings.
5. Variants were called using GATK HaplotypeCaller. Only reads with a mapping quality ≥30 were considered and the minimum base quality (Phred score) for counting a non-reference base was set to 20. Standard settings for variant calling in RNA-seq were used: minimum-base-quality=20, minimum-mapping-quality=30, don't-use-soft-clipped-bases, standard-call-conf=20.
6. Mutations private to base-editor treated samples were identified using background filtration. The highest coverage 'No Treatment' sample was used as the background sample. Only substitutions on canonical chromosomes were considered. Mutations were considered private to the base-editor treated sample if they met the following criteria:
   a. The genomic position of the mutation had coverage ≥30 reads in the treated sample and ≥20 reads in the untreated sample
   b. The untreated sample had ≥99% of reads supporting the reference, non-mutant, base at the position of the mutation
   c. The variant allele frequency of the mutation in the treated sample was ≥20%.

Whole Genome Sequencing Analysis Details
1. Lane level FASTQ files were separately aligned to the human genome (Gencode GRCh38v31 primary assembly) using BWA (0.7.17-r1188) mem with parameters set to specify the ReadGroup. The -M flag was also set to mark shorted split hits a secondary alignments.
2. Lane level genome alignments for each sample created in step (1) were merged, sorted by coordinate, and duplicate marked using Picard (v2.20.5) using default settings.
3. Variants were called using GATK (v4.1.3.0) HaplotypeCaller. Only reads with a mapping quality ≥30 were considered and the minimum base quality (Phred score) for counting a non-reference base was set to 20. Standard settings for variant calling in DNA-seq were used.
4. Mutations private to base-editor treated samples were identified using background filtration. The highest coverage 'No Treatment' sample was used as the background sample. Only substitutions on canonical chromosomes were considered. Mutations were considered private to the base-editor treated sample if they met the following criteria:
   a. The genomic position of the mutation had coverage ≥10 reads in the treated and untreated sample
   b. The untreated sample had ≥99% of reads supporting the reference, non-mutant, base at the position of the mutation Analysis of DNA and RNA Off-Target Editing for ABE Architecture and ABE8 Constructs HEK293T cells were plated on 48-well poly-D-lysine coated plates (Corning) 16 to 20 hours before lipofection at a density of 30,000 cells per well in DMEM+Glutamax medium (Thermo Fisher Scientific) without antibiotics. 750 ng nickase or base editor expression plasmid DNA was combined with 250 ng of sgRNA expression plasmid DNA in 15 μl OPTIMEM+Glutamax. This was combined with 10 μl of lipid mixture, comprising 1.5 μl Lipofectamine 2000 and 8.5 μl OPTIMEM+Glutamax per well. Cells were harvested 3 days after transfection and either DNA or RNA was harvested. For DNA analysis, cells were washed once in 1×PBS, and then lysed in 100 μl QuickExtract™ Buffer (Lucigen) according to the manufacturer's instructions. For RNA harvest, the MagMAX™ mirVana™ Total RNA Isolation Kit (Thermo Fisher Scientific) was used with the KingFisher™ Flex Purification System according to the manufacturer's instructions.

Figure 53A:
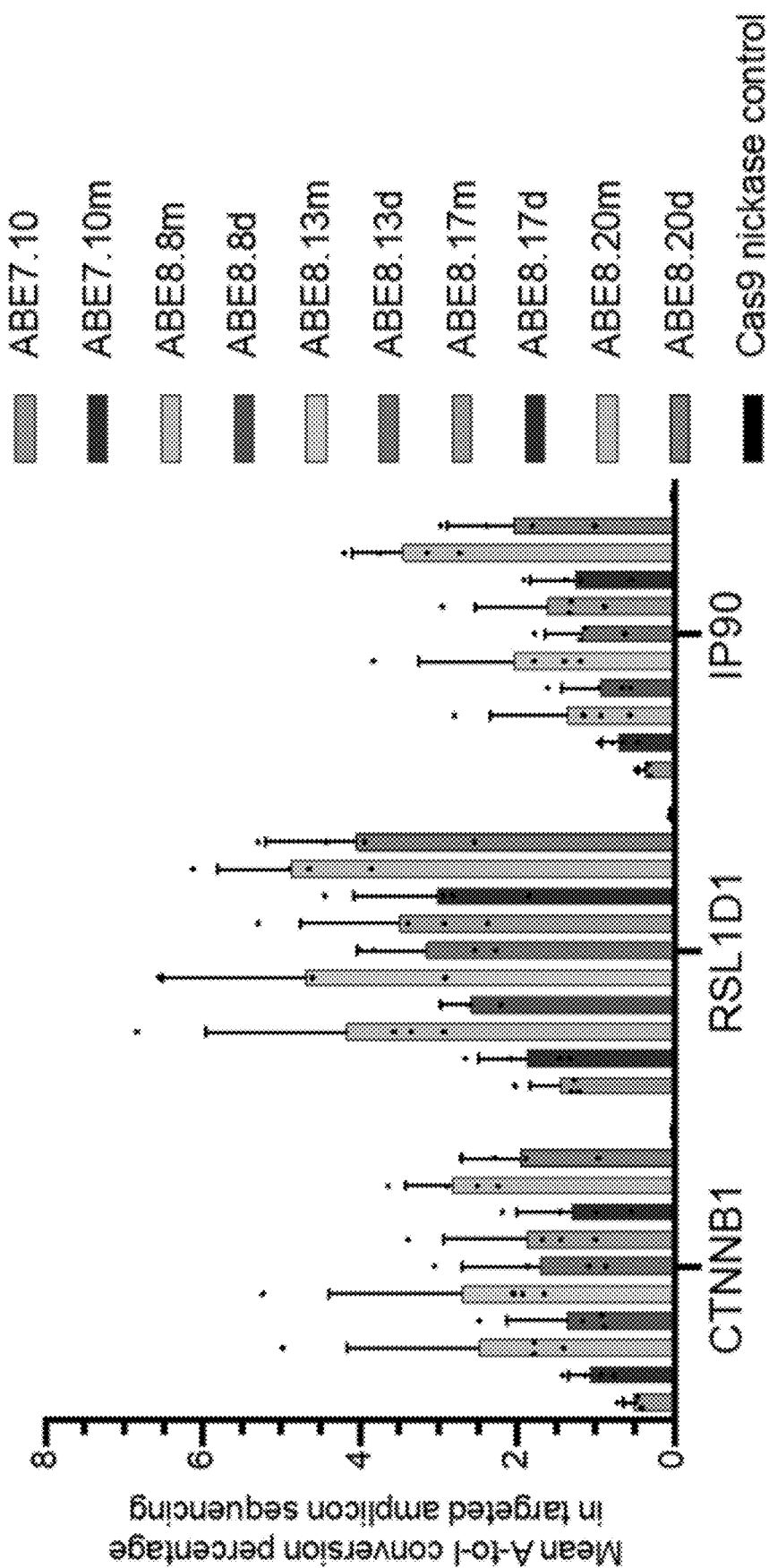
FIGS. 53A-53C depict RNA amplicon sequencing to detect cellular A-to-I editing in RNA associated with ABE treatment. Individual data points are shown and error bars represent s.d. for n=3 independent biological replicates, performed on different days.
Figure 53B:
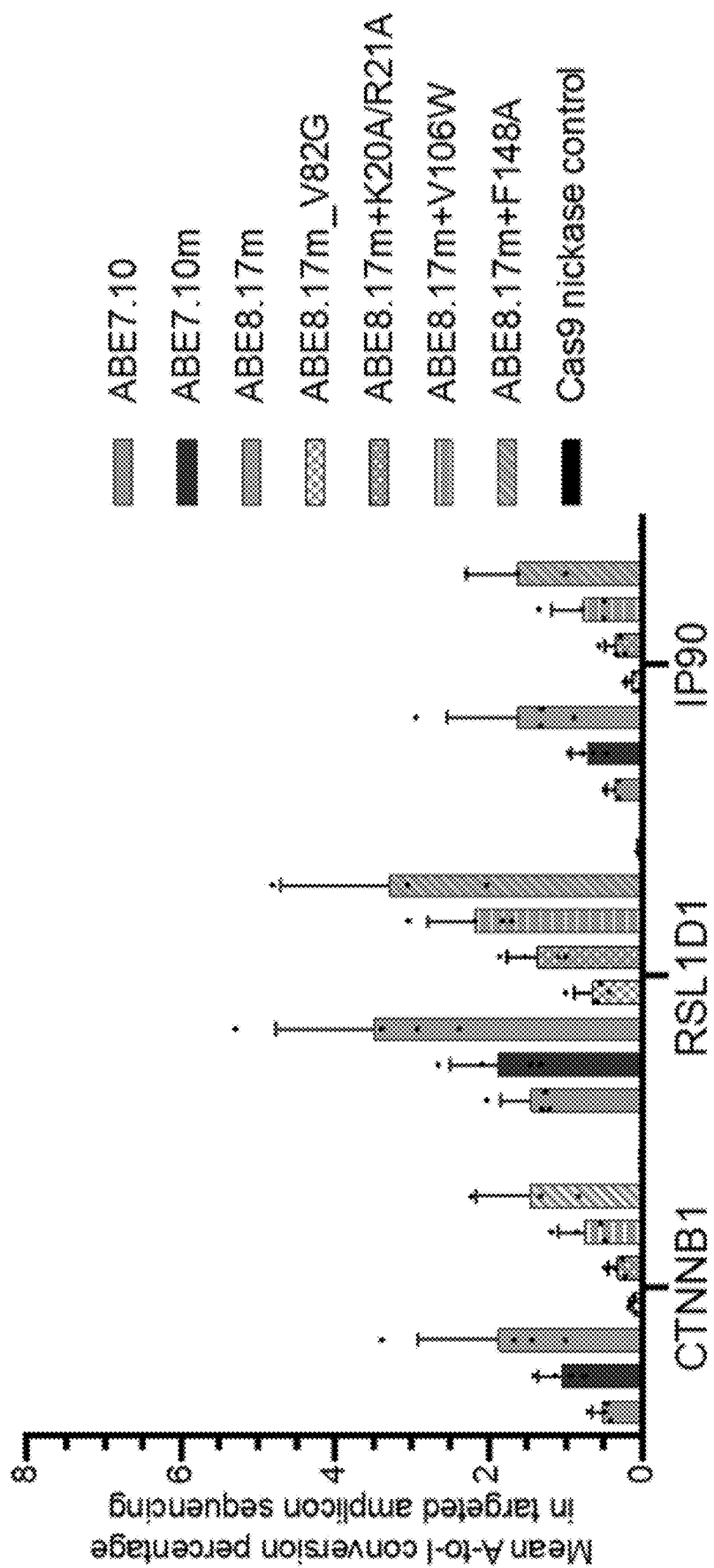
Figure 53C:
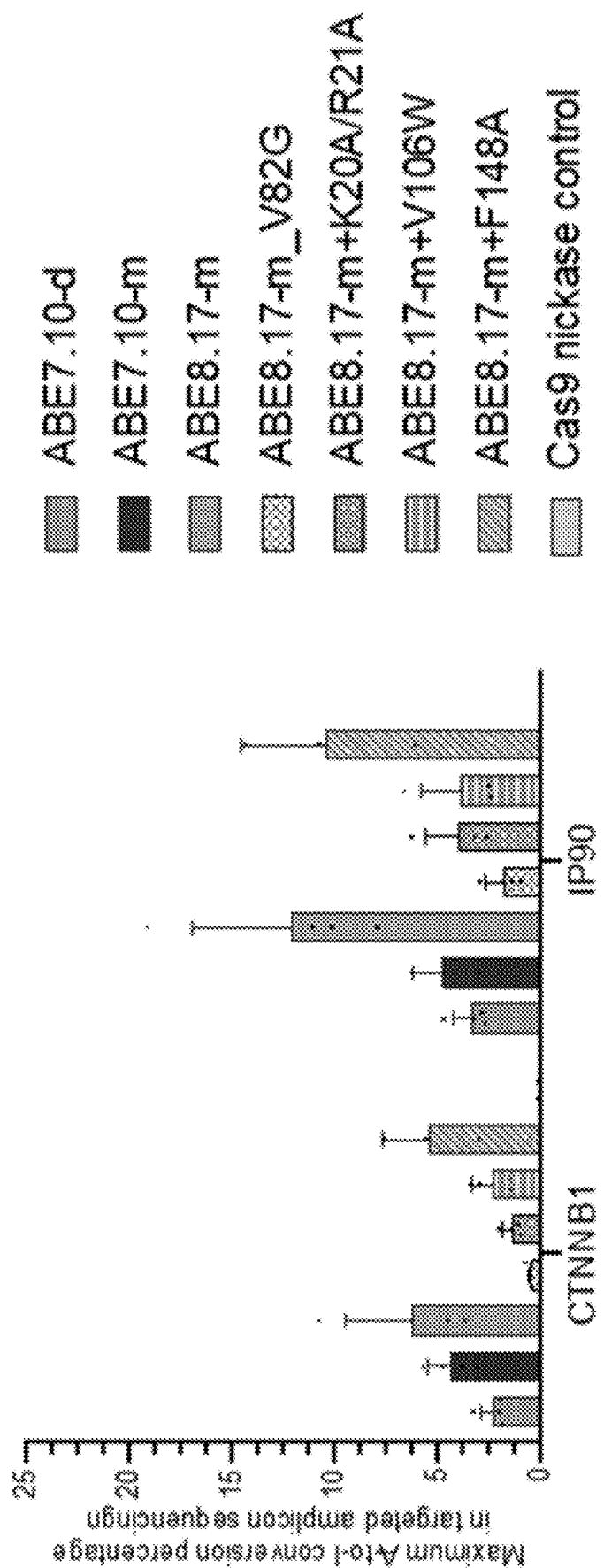

Targeted RNA sequencing was performed largely as previously described (see Rees, H. A. et al., Analysis and minimization of cellular RNA editing by DNA adenine base editors. *Sci Adv* 5, eaax5717, doi:10.1126/sciadv.aax5717 (2019)). cDNA was prepared from the isolated RNA using the SuperScript IV One-Step RT-PCR System with EZDnase (Thermo Fisher Scientific) according to the manufacturer's instructions. The following program was used: 58° C. for 12 min; 98° C. for 2 min; followed by PCR cycles which varied by amplicon: for CTNNB1 and IP90: 32 cycles of [98° C. for 10 sec; 60° C. for 10 sec; 72° C. for 30 sec] and for RSL1D1 35 cycles of [98° C. for 10 sec; 58° C. for 10 sec; 72° C. for 30 sec]. No RT controls were run concurrently with the samples. Following the combined RT-PCR, amplicons were barcoded and sequenced using an Illumina Miseq as described herein. The first 125 nt in each amplicon, beginning at the first base after the end of the forward primer in each amplicon, was aligned to a reference sequence and used for analysis of mean and maximum A-to-I frequencies in each amplicon (FIGS. 53A-53C).

Off-target DNA sequencing was performed using previously published primers (see Komor, A. C. et al., Programmable editing of a target base in genomic DNA without double-stranded DNA cleavage. Nature 533, 420-424, doi: 10.1038/nature17946 (2016); Rees, H. A. et al., Analysis and minimization of cellular RNA editing by DNA adenine base editors. *Sci Adv* 5, eaax5717, doi: 10.1126/sciadv.aax5717 (2019)) listed in Table 19 below using a two-step PCR and barcoding method to prepare samples for sequencing using Illumina Miseq sequencers as described herein.

TABLE 19

| Primer Name | Sequence |
|---|---|
| fwd_site_1 | ACACTCTTTCCCTACACGACGCTCTTCCGATCTNNNNCCAGCCCCATCTGTCAAACT (SEQ ID NO: 282) |
| rev_site_1 | TGGAGTTCAGACGTGTGCTCTTCCGATCTTGAATGGATTCCTTGGAAACAATGA (SEQ ID NO: 283) |
| fwd_site_2 | ACACTCTTTCCCTACACGACGCTCTTCCGATCTNNNNTGAGGGAGAGCCGTGTAGTT (SEQ ID NO: 284) |
| rev_site_2 | TGGAGTTCAGACGTGTGCTCTTCCGATCTGCCTCTCAAAGTGCTGGGAT (SEQ ID NO: 285) |
| fwd_site_3 | ACACTCTTTCCCTACACGACGCTCTTCCGATCTNNNNCCATCAGGCTCTCAGCTCAG (SEQ ID NO: 286) |
| rev_site_3 | TGGAGTTCAGACGTGTGCTCTTCCGATCTCTCGTGGGTTTGTGGTTGC (SEQ ID NO: 287) |
| fwd_site_4 | ACACTCTTTCCCTACACGACGCTCTTCCGATCTNNNNGCCCATTCCCTCTTTAGCCA (SEQ ID NO: 288) |
| rev_site_4 | TGGAGTTCAGACGTGTGCTCTTCCGATCTGAGCCGTTCCCTCTTTGCTA (SEQ ID NO: 289) |
| fwd_site_5 | ACACTCTTTCCCTACACGACGCTCTTCCGATCTNNNNAACCTGTGTGACACTTGGCA (SEQ ID NO: 290) |
| rev_site_5 | TGGAGTTCAGACGTGTGCTCTTCCGATCTGTCTGGCCCAAGATCACACA (SEQ ID NO: 291) |
| fwd_site_6 | ACACTCTTTCCCTACACGACGCTCTTCCGATCTNNNCACGGATAAAGACGCTGGGA (SEQ ID NO: 292) |
| rev_site_6 | TGGAGTTCAGACGTGTGCTCTTCCGATCTGGGGTCCCAGGTGCTGAC (SEQ ID NO: 293) |
| fwd_site_7 | ACACTCTTTCCCTACACGACGCTCTTCCGATCTNNNTGATTGTCTCCTTTGCCGC (SEQ ID NO: 294) |
| rev_site_7 | TGGAGTTCAGACGTGTGCTCTTCCGATCTTGACCCAGTGTTTGATAGATCAGT (SEQ ID NO: 295) |
| fwd_site_8 | ACACTCTTTCCCTACACGACGCTCTTCCGATCTNNNCACCCCTTCAGTCCATGCTT (SEQ ID NO: 296) |
| rev_site_8 | TGGAGTTCAGACGTGTGCTCTTCCGATCTTCTGATGGGGAGGAACGAGT (SEQ ID NO: 297) |
| fwd_site_9 | ACACTCTTTCCCTACACGACGCTCTTCCGATCTNNNNCAGCTCAGCCTGAGTGTTGA (SEQ ID NO: 298) |
| rev_site_9 | TGGAGTTCAGACGTGTGCTCTTCCGATCTGCCCACCCTAGTCATTGGAG (SEQ ID NO: 299) |
| fwd_site_10 | ACACTCTTTCCCTACACGACGCTCTTCCGATCTNNNNGTCAGAGGGACACACTGTGG (SEQ ID NO: 300) |
| rev_site_10 | TGGAGTTCAGACGTGTGCTCTTCCGATCTCACACTCACTCACCCACACA (SEQ ID NO: 301) |
| fwd_site_11 | ACACTCTTTCCCTACACGACGCTCTTCCGATCTNNNNTGTGTGGGTGAGTGAGTGTG (SEQ ID NO: 302) |
| rev_site_11 | TGGAGTTCAGACGTGTGCTCTTCCGATCTCACCAAGGTTCACAGCCTGA (SEQ ID NO: 303) |
| fwd_site_12 | ACACTCTTTCCCTACACGACGCTCTTCCGATCTNNNNTTGTCTCTGCCTGTAGCTGC (SEQ ID NO: 304) |
| rev_site_12 | TGGAGTTCAGACGTGTGCTCTTCCGATCTCGCTCTGGGCTTCATCTTCA (SEQ ID NO: 305) |
| fwd_site_13 | ACACTCTTTCCCTACACGACGCTCTTCCGATCTNNNNTGGGATTATGGGTGTGAGCC (SEQ ID NO: 306) |

TABLE 19-continued

HTS Primers used to amplify genomic sites

| Primer Name | Sequence |
|---|---|
| rev_site_13 | TGGAGTTCAGACGTGTGCTCTTCCGATCTTGCCTTCCTCCTCTCTCTCC (SEQ ID NO: 307) |
| fwd_site_14 | ACACTCTTTCCCTACACGACGCTCTTCCGATCTNNNNTGCAGACCAGATTCGGAGAA (SEQ ID NO: 308) |
| rev_site_14 | TGGAGTTCAGACGTGTGCTCTTCCGATCTGTTCAGTTTCCAGGGGGTCC (SEQ ID NO: 309) |
| fwd_site_15 | ACACTCTTTCCCTACACGACGCTCTTCCGATCTNNNNTCCGCACAGCCTTAGTTCAA (SEQ ID NO: 310) |
| rev_site_15 | TGGAGTTCAGACGTGTGCTCTTCCGATCTAACTTGAAGAGACGGCAGCA (SEQ ID NO: 311) |
| fwd_site_16 | ACACTCTTTCCCTACACGACGCTCTTCCGATCTNNNNCCCCAGCTACAGAAAGGTC (SEQ ID NO: 312) |
| rev_site_16 | TGGAGTTCAGACGTGTGCTCTTCCGATCTATTTCCACCGCAAAATGGCC (SEQ ID NO: 313) |
| fwd_site_17 | ACACTCTTTCCCTACACGACGCTCTTCCGATCTNNNNTCACTTCAGCCCAGGAGTAT (SEQ ID NO: 314) |
| rev_site_17 | TGGAGTTCAGACGTGTGCTCTTCCGATCTTGTGTATGGTGAGAGGTAGGGA (SEQ ID NO: 315) |
| fwd_site_18 | ACACTCTTTCCCTACACGACGCTCTTCCGATCTNNNNGTCTGAGGTCACACAGTGGG (SEQ ID NO: 316) |
| rev_site_18 | TGGAGTTCAGACGTGTGCTCTTCCGATCTCTGAGAGCAGGGACCACATC (SEQ ID NO: 317) |
| fwd_site_19 | ACACTCTTTCCCTACACGACGCTCTTCCGATCTNNNNGGGAGGTGGAGAGAGGATGT (SEQ ID NO: 318) |
| rev_site_19 | TGGAGTTCAGACGTGTGCTCTTCCGATCTACTCTTCCTGAGGTCTAGGAACCCG (SEQ ID NO: 319) |
| fwd_site_20 | ACACTCTTTCCCTACACGACGCTCTTCCGATCTNNNNCCCTGTTCCTAAAGCCCACC (SEQ ID NO: 320) |
| rev_site_20 | TGGAGTTCAGACGTGTGCTCTTCCGATCTACTCTCTGGTTCTGTTTGTGGCCA (SEQ ID NO: 321) |
| fwd_CTNNB1 | ACACTCTTTCCCTACACGACGCTCTTCCGATCTNNNNATTTGATGGAGTTGGACATGGCC (SEQ ID NO: 322) |
| rev_CTNNB1 | TGGAGTTCAGACGTGTGCTCTCCAGCTACTTGTTCTTGAGTGAAGG (SEQ ID NO: 323) |
| fwd_RSL1D1 | ACACTCTTTCCCTACACGACGCTCTTCCGATCTNNNNTGGCTTTCCAAATCAGTGGGTC (SEQ ID NO: 324) |
| rev_RSL1D1 | TGGAGTTCAGACGTGTGCTCTTCCGATCTCTCATAAGCTTAGACCAACAAGC (SEQ ID NO: 325) |
| fwd_IP90 | ACACTCTTTCCCTACACGACGCTCTTCCGATCTNNNNCTGGTTGACCAATCTGTGGTG (SEQ ID NO: 326) |
| rev_IP90 | TGGAGTTCAGACGTGTGCTCTCTGCGTCTGGATCAGGTACG (SEQ ID NO: 327) |
| fwd_HEK293_site2_off1 | ACACTCTTTCCCTACACGACGCTCTTCCGATCTNNNNGTGTGGAGAGTGAGTAAGCCA (SEQ ID NO: 328) |
| rev_HEK293_site2_off1 | TGGAGTTCAGACGTGTGCTCTTCCGATCTACGGTAGGATGATTTCAGGCA (SEQ ID NO: 329) |
| fwd_HEK293_site2_off2 | ACACTCTTTCCCTACACGACGCTCTTCCGATCTNNNNCACAAAGCAGTGTAGCTCAGG (SEQ ID NO: 330) |
| rev_HEK293_site2_off2 | TGGAGTTCAGACGTGTGCTCTTCCGATCTTTTTTGGTACTCGAGTGTTATTCAG (SEQ ID NO: 331) |

TABLE 19-continued

HTS Primers used to amplify genomic sites

| Primer Name | Sequence |
|---|---|
| fwd_HEK293_site3_off1 | ACACTCTTTCCCTACACGACGCTCTTCCGATCTNNNNTCCCCTGTTGACCTGGAGAA (SEQ ID NO: 332) |
| rev_HEK293_site3_off1 | TGGAGTTCAGACGTGTGCTCTTCCGATCTCACTGTACTTGCCCTGACCA (SEQ ID NO: 333) |
| fwd_HEK293_site3_off2 | ACACTCTTTCCCTACACGACGCTCTTCCGATCTNNNNTTGGTGTTGACAGGGAGCAA (SEQ ID NO: 334) |
| rev_HEK293_site3_off2 | TGGAGTTCAGACGTGTGCTCTTCCGATCTCTGAGATGTGGGCAGAAGGG (SEQ ID NO: 335) |
| fwd_HEK293_site3_off3 | ACACTCTTTCCCTACACGACGCTCTTCCGATCTNNNNTGAGAGGGAACAGAAGGGCT (SEQ ID NO: 336) |
| rev_HEK293_site3_off3 | TGGAGTTCAGACGTGTGCTCTTCCGATCTGTCCAAAGGCCCAAGAACCT (SEQ ID NO: 337) |
| fwd_HEK293_site3_off4 | ACACTCTTTCCCTACACGACGCTCTTCCGATCTNNNNTCCTAGCACTTTGGAAGGTCG (SEQ ID NO: 338) |
| rev_HEK293_site3_off4 | TGGAGTTCAGACGTGTGCTCTTCCGATCTGCTCATCTTAATCTGCTCAGCC (SEQ ID NO: 339) |
| fwd_HEK293_site3_off5 | ACACTCTTTCCCTACACGACGCTCTTCCGATCTNNNNAAAGGAGCAGCTCTTCCTGG (SEQ ID NO: 340) |
| rev_HEK293_site3_off5 | TGGAGTTCAGACGTGTGCTCTTCCGATCTGTCTGCACCATCTCCCACAA (SEQ ID NO: 341) |
| fwd_HEK293_site4_off1 | ACACTCTTTCCCTACACGACGCTCTTCCGATCTNNNNGGCATGGCTTCTGAGACTCA (SEQ ID NO: 342) |
| rev_HEK293_site4_off1 | TGGAGTTCAGACGTGTGCTCTTCCGATCTGTCTCCCTTGCACTCCCTGTCTTT (SEQ ID NO: 343) |
| fwd_HEK293_site4_off2 | ACACTCTTTCCCTACACGACGCTCTTCCGATCTNNNNTTTGGCAATGGAGGCATTGG (SEQ ID NO: 344) |
| rev_HEK293_site4_off2 | TGGAGTTCAGACGTGTGCTCTTCCGATCTGAAGAGGCTGCCCATGAGAG (SEQ ID NO: 345) |
| fwd_HEK293_site4_off3 | ACACTCTTTCCCTACACGACGCTCTTCCGATCTNNNNGGTCTGAGGCTCGAATCCTG (SEQ ID NO: 346) |
| rev_HEK293_site4_off3 | TGGAGTTCAGACGTGTGCTCTTCCGATCTCTGTGGCCTCCATATCCCTG (SEQ ID NO: 347) |
| fwd_HEK293_site4_off4 | ACACTCTTTCCCTACACGACGCTCTTCCGATCTNNNNTTTCCACCAGAACTCAGCCC (SEQ ID NO: 348) |
| rev_HEK293_site4_off4 | TGGAGTTCAGACGTGTGCTCTTCCGATCTCCTCGGTTCCTCCACAACAC (SEQ ID NO: 349) |
| fwd_HEK293_site4_off5 | ACACTCTTTCCCTACACGACGCTCTTCCGATCTNNNNCACGGGAAGGACAGGAGAAG (SEQ ID NO: 350) |
| rev_HEK293_site4_off5 | TGGAGTTCAGACGTGTGCTCTTCCGATCTGCAGGGGAGGGATAAAGCAG (SEQ ID NO: 351) |
| fwd_HEK_site_3 | ACACTCTTTCCCTACACGACGCTCTTCCGATCTNNNNGGAAACGCCCATGCAATTAGTC (SEQ ID NO: 352) |
| rev_HEK_site_3 | TGGAGTTCAGACGTGTGCTCTTCCGATCTCTTGTCAACCAGTATCCCGGTG (SEQ ID NO: 353) |
| fwd_HEK_site_2 | ACACTCTTTCCCTACACGACGCTCTTCCGATCTNNNNTGAATGGATTCCTTGGAAACAATG (SEQ ID NO: 354) |
| rev_HEK_site_2 | TGGAGTTCAGACGTGTGCTCTTCCGATCTCCAGCCCCATCTGTCAAACT (SEQ ID NO: 355) |
| fwd_HEK_site_4 | TGGAGTTCAGACGTGTGCTCTTCCGATCTTCCTTTCAACCCGAACGGAG (SEQ ID NO: 356) |

TABLE 19-continued

HTS Primers used to amplify genomic sites

| Primer Name | Sequence |
| --- | --- |
| rev_HEK_site_4 | ACACTCTTTCCCTACACGACGCTCTTCCGATCTNNNNGCTGGTCTTCTTTCCCCTCC (SEQ ID NO: 357) |
| fwd_LDLR | ACACTCTTTCCCTACACGACGCTCTTCCGATCTNNNNGCCCTGCTTCTTTTTCTCTGGT (SEQ ID NO: 358) |
| rev_LDLR | TGGAGTTCAGACGTGTGCTCTTCCGATCTACCATTAACGCAGCCAACTTCA (SEQ ID NO: 359) |
| fwd_TRAC | ACACTCTTTCCCTACACGACGCTCTTCCGATCTCATGAGGTCTATGGACTTCAAGAGCAA (SEQ ID NO: 360) |
| Rev_TRAC | TGGAGTTCAGACGTGTGCTCTTCCGATCTCATCATTGACCAGAGCTCTGGGCAGAA (SEQ ID NO: 361) |
| fwd_CBLB | ACACTCTTTCCCTACACGACGCTCTTCCGATCTGCACTTACCAGCATTACTTCCTAAACC (SEQ ID NO: 362) |
| Rev_CBLB | TGGAGTTCAGACGTGTGCTCTTCCGATCTATGGGCTCCACTTTTCAGCTCTGTAA (SEQ ID NO: 363) |
| fwd_CD7 | ACACTCTTTCCCTACACGACGCTCTTCCGATCTCAGTTCAGGCACATGTAGGAGGGA (SEQ ID NO: 364) |
| Rev_CD7 | TGGAGTTCAGACGTGTGCTCTTCCGATCTACCGCCTGCAGCTGTCGGACACTGGCA (SEQ ID NO: 365) |
| fwd_B2M | ACACTCTTTCCCTACACGACGCTCTTCCGATCTAAAAGATGAGTATGCCTGCCGTG (SEQ ID NO: 366) |
| Rev_B2M | TGGAGTTCAGACGTGTGCTCTTCCGATCTCAGATTGTTTATATCAGATGGGATGGG (SEQ ID NO: 367) |
| fwd_CIITA | ACACTCTTTCCCTACACGACGCTCTTCCGATCTATGCAAGTTTGGTCCTGAGCCCTCCC (SEQ ID NO: 368) |
| Rev_CIITA | TGGAGTTCAGACGTGTGCTCTTCCGATCTGATGTGGGTTCCCTGCGCTCTGCA (SEQ ID NO: 369) |
| fwd_PDCD1 | ACACTCTTTCCCTACACGACGCTCTTCCGATCTCCAGGGACTGAGGGTGGAAGGTCC (SEQ ID NO: 370) |
| Rev_PDCD1 | TGGAGTTCAGACGTGTGCTCTTCCGATCTACCTCCGCCTGAGCAGTGGAGAA (SEQ ID NO: 371) | mRNA Production for ABE Editors Used in CD34+ Cells

Editors were cloned into a plasmid encoding a dT7 promoter followed by a 5'UTR, Kozak sequence, ORF, and 3'UTR. The dT7 promoter carries an inactivating point mutation within the T7 promoter that prevents transcription from circular plasmid. This plasmid templated a PCR reaction (Q5 Hot Start 2× Master Mix), in which the forward primer corrected the SNP within the T7 promoter and the reverse primer appended a 120A tail (SEQ ID NO: 372) to the 3' UTR. The resulting PCR product was purified on a Zymo Research 25 µg DCC column and used as mRNA template in the subsequent in vitro transcription. The NEB HiScribe High-Yield KiT was used per the instruction manual but with full substitution of N-methyl-pseudouridine for uridine and co-transcriptional capping with CleanCap AG (Trilink). Reaction cleanup was performed by lithium chloride precipitation. Primers used for amplification can be found in Table 20. The Cas9 mRNA was purchased from Trilink (CleanCap Cas9 mRNA 5moU).

TABLE 20

Primers used for ABE8 T7 in vitro transcription reactions

| Name | Sequence |
| --- | --- |
| fwd_IVT | TCGAGCTCGGTACCTAATACGACTCAC (SEQ ID NO: 373) |
| rev_IVT | TTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTCTTCCTACTCAGGCTTTATTCAAAGACCA (SEQ ID NO: 374) |

CD34+ Cell Preparation

Mobilized peripheral blood was obtained and enriched for Human CD34+ HSPCs (HemaCare, M001F-GCSF/MOZ- 2). The CD34+ cells were thawed and put into X-VIVO 10 (Lonza) containing 1% Glutamax (Gibco), 100 ng/mL of TPO (Peprotech), SCF (Peprotech) and Flt-3 (Peprotech) at 48 hours prior to electroporation Electroporation of CD34+ Cells 48 hours post thaw, the cells were spun down to remove the X-VIVO 10 media and washed in MaxCyte buffer (HyClone) with 0.1% HSA (Akron Biotechnologies). The cells were then resuspended in cold MaxCyte buffer at 1,250,000 cells per mL and split into multiple 20 μL aliquots. The ABE mRNA (0.15 μM) and −198 HBG1/2 sgRNA (4.05 μM) were then aliquoted as per the experimental conditions and raised to a total of 5 μL in MaxCyte buffer. The sequences of the sgRNAs are provided in Table 21. The 20 μL of cells was the added into the 5 μL RNA mixture in groups of 3 and loaded into each chamber of an OC25x3 MaxCyte cuvette for electroporation. After receiving the charge, 25 μL was collected from the chambers and placed in the center of the wells in a 24-well untreated culture plate. The cells recovered for 20 minutes in an incubator (37° C., 5% $CO_2$). After the 20 minutes recovery, X-VIVO 10 containing 1% Glutamax, 100 ng/mL of TPO, SCF and Flt-3 was added to the cells for a concentration of 1,000,000 cells per mL. The cells were then left to further recover in an incubator (37° C., 5% $CO_2$) for 48 hrs.

"Phase 2" IMDM media containing 5% human serum (Sigma), 330 μg/mL transferrin, 10 μg/mL human insulin, 2U/mL heparin sodium, 3U/mL EPO and 100 ng/mL SCF at 200,000 cells per mL. On day 11, cells were spun down and moved to "Phase 3" IMDM media containing 5% human serum, 330 μg/mL of transferrin, 10 μg/mL human insulin, 2U/mL of heparin sodium and 3 U/mL of EPO at 1,000,000 cells per mL. On day 14, the cells were spun down and resuspended in the same media as day 11 but at 5,000,000 cells per mL. On day 18, the differentiated red blood cells were collected in 500,000 cell aliquots, washed once in 500 μL DPBS (Gibco) and frozen at −80° C. for 24 hours before UHPLC processing.

Preparation of Red Blood Cell Sample for UHPLC Analysis

Frozen red blood cell pellets were thawed at room temperature. Pellets were diluted to a final concentration of $5 \times 10^4$ cells/L with ACK lysis buffer. Samples were mixed by pipette and incubated at room temperate for 5 min. Samples were then frozen in at −80° C. for 5 min, allowed to thaw, and mixed by pipette prior to centrifugation at 6,700g for 10 min. The supernatant was carefully removed (without disturbing cell debris pellet), transferred to a new plate and diluted to $5 \times 10^3$ cells/μL in ultrapure water for UHPLC analysis.

TABLE 21

Sequences of sgRNAs used for CD34+ transfections

| Site | RNA spacer sequence | Cas9 scaffold | supplier |
|---|---|---|---|
| 21 | csususACCCCACUUAACUAUCU (SEQ ID NO: 375) | S. pyogenes | Synthego |
| 22 | cscscsUACCUGUCACCAGGAC C (SEQ ID NO: 376) | S. pyogenes | Synthego |
| 23 | csascsCUACCUAAGAACCAUCC (SEQ ID NO: 377) | S. pyogenes | Synthego |
| 24 | csascsUCACCUUAGCCUGAGC A (SEQ ID NO: 378) | S. pyogenes | Synthego |
| 25 | csususACCUGGGCUGGGGAAG A (SEQ ID NO: 379) | S. pyogenes | Synthego |
| 26 | asususAUACCUGCCAUGCCGU A (SEQ ID NO: 380) | S. pyogenes | Synthego |
| −198 HBG1/2 | gsusgsGGGAAGGGGCCCCCAA G (SEQ ID NO: 381) | S. pyogenes | Biospring |

A, C, G, U: 2'-O-methyl residues
s: phosphorothioate sgRNA Scaffold Sequences:

S. pyogenes:
5'-GUUUUAGAGCUAGAAAUAGCAAGUUAAAAUAAGGCUAGUCCGUUAUC AACUUGAAAAAGUGGCACCGAGUCGGUGCUsususu-3'
(SEQ ID NO: 382)

Erythrocyte Differentiation Post ABE Electroporation

Following 48 h post electroporation rest (day 0 of culture), the cells were spun down and moved to "Phase 1" IMDM media (ATCC) containing 5% human serum, 330 μg/mL transferrin (Sigma), 10 μg/mL human insulin (Sigma), 2U/mL heparin sodium (Sigma), 3U/mL EPO (Peprotech), 100 ng/mL SCF (Peprotech), 5 μg/mL IL3 and 50 μM hydrocortisone (Sigma) at 20,000 cells per mL. On day 4 of culture, the cells were fed 4× volume of the same media. On day 7, the cells were spun down and moved to Ultra-High Performance Liquid Chromatography (UHPLC) Analysis Reverse-phase separation of globin chains was performed on a UHPLC system configured with a binary pump and UV detector (Thermo Fisher Scientific, Vanquish Horizon). The stationary phase consisted of an ACQUITY Peptide BEH C18 Column (2.1×150 mm, 1.7 m beads, 300A pores) after an AQUITY Peptide BEH C18 VanGuard pre-column (2.1×5 mm, 1.7 μm beads, 300 A pores)(both Waters Corp) with a column temperature of 60° C. Elution was preformed using 0.1% trifluoroacetic acid (TFA) in water (A) and 0.08% TFA in acetonitrile (B) with a flow rate of 0.25 mL/min. Separation of the globin chains was achieved using a linear gradient of 40-52% B from 0-10 min; 52-40% B from 10-10.5 min; 40% B to 12 min. Sample injection volume was 10 μL, UV spectra at a wavelength of 220 nm with a data rate of 5 Hz was collected throughout the analysis. Globin chain identities were confirmed through LC/MS analysis of hemoglobin standards.

Genomic DNA Extraction for CD34+ Cells

Following ABE electroporation (48h later), an aliquot of cells was cultured in X-VIVO 10 media (Lonza) containing 1% Glutamax (Gibco), 100 ng/mL of TPO (Peprotech), SCF (Peprotech) and Flt-3 (Peprotech). Following 48 h and 144 h post culturing, 100,000 cells were collected and spun down. 50 µL of Quick Extract (Lucigen) was added to the cell pellet and the cell mixture was transferred to a 96-well PCR plate (Bio-Rad). The lysate was heated for 15 minutes at 65° C. followed by 10 minutes at 98° C. The cell lysates were stored at −20° C.

Next Generation Sequencing (NGS) of Genomic DNA Samples

Genomic DNA samples were amplified and prepared for high throughput sequencing (see Gaudelli, N. M. et al. Programmable base editing of A*T to G*C in genomic DNA without DNA cleavage. Nature 551, 464-471, doi:10.1038/nature24644 (2017)). 1 µL of gDNA was added to a 25 µL PCR reaction containing Phusion U Green Multiplex PCR Master Mix and 0.5 µM of each forward and reverse primer. Following amplification, PCR products were barcoded using unique Illumina barcoding primer pairs. Barcoding reactions contained 0.5 µM of each illumina forward and reverse primer, 2 µL of PCR mixture containing amplified genomic site of interest, and Q5 Hot Start High-Fidelity 2× Master Mix in a total volume of 25 µL. All PCR conditions were carried out as previously published (see Gaudelli, N. M. et al. Programmable base editing of A*T to G*C in genomic DNA without DNA cleavage. Nature 551, 464-471, doi: 10.1038/nature24644 (2017)). Primers used for site-specific mammalian cell genomic DNA amplification are listed in Table 19. DNA concentration was quantified using a Nano-Drop 1000 Spectrophotometer (ThermoFisher Scientific) and sequenced on an Illumina MiSeq Instrument according to the manufacturer's protocols.

Targeted NGS Data Analysis

All targeted NGS data were analyzed by performing four general steps: (1) Illumina demultiplexing, (2) read trimming and filtering, (3) alignment of all reads to the expected amplicon sequence, and (4) generation of alignment statistics and quantification of editing rates. Each step is described in more detail below:

1. To generate FASTQ files from the base call files (BCF) generated by the MiSeq, demultiplexing was performed by running Illumina bcl2fastq (v2.20.0.422) with the following parameters:
bcl2fastq\
  --ignore-missing-bcls\
  --ignore-missing-filter\
  --ignore-missing-positions\
  --ignore-missing-controls\
  --auto-set-to-zero-barcode-mismatches\
  --find-adapters-with-sliding-window\
  --adapter-stringency 0.9\
  --mask-short-adapter-reads 35\
  --minimum-trimmed-read-length 35\

2. The FASTQ files created in step (1) were processed using trimmomatic (v0.39)14 with parameters set up to clip Illumina TruSeq adapters, exclude reads shorter than 20 bases, and trim the remaining 3' end of reads if the average base quality (Phred score) in a 4-bp sliding window dropped below 15. In addition, any bases with quality scores of 3 or lower at the end of reads were removed. Finally, because the round 1 PCR primers include four randomized bases after the read 1 primer sequence, the first four bases of each read were trimmed. The command used to execute trimmomatic is shown below:
trimmomatic SE-phred33 $input_fastq $output_fastq\
  ILLUMINACLIP:illumine_adapters.fa:2:30:10\
  LEADING:3 TRAILING:3\
  SLIDINGWINDOW:4:15\
  MINLEN:20\
  HEADCROP:4

3. Reads were aligned to amplicon sequences using bowtie2 (v2.35)15, in end-to-end mode with the alignment parameters specified by the—very sensitive flag. Reference sequences were determined as the expected amplicon sequences (including primers) for each primer pair based on the human genome (GRCh38).The SAM files created by bowtie2 were converted to BAM files, sorted, and indexed using the samtools package (v1.9)16. Only samples with at least 5,000 aligned reads were considered for analysis.

4. The BAM files created in step (3) were processed using the bam-readcounts tool (https://github.com/genome/bam-readcount) to generate plain text files summarizing the number of non-reference bases, deletions and insertions at each position in the alignment. The minimum base quality (Phred score) for counting a non-reference base was set to 29 in order to exclude low confidence base calls from statistics about editing rates. Only reads with insertions and/or deletions that overlapped the base editor target site (defined as its protospacer+PAM sequence) were counted towards insertion and deletion rates. Editing rates for each position in the target site were calculated as the fraction of non-reference bases of a given type (e.g., G) to the total number of bases passing the base quality threshold at a given position in the alignment.

In an additional analysis conducted using the same computational analysis approach, the haplotypes generated by ABE7 and ABE8 at different genetic loci are shown in FIG. 60.

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

The following numbered additional embodiments encompassing the methods and compositions of the disclosure are envisioned herein:

1. An adenosine deaminase comprising: an amino acid sequence that comprises a modification at an amino acid position 82 or 166 as numbered in SEQ ID NO: 2, or a corresponding modification in another adenosine deaminase, wherein the amino acid sequence of the adenosine deaminase comprises at least 85% sequence identity to SEQ ID NO:2.
2. The adenosine deaminase of embodiment 1, wherein the adenosine deaminase deaminates a nucleobase of a deoxyribonucleic acid (DNA) sequence.
3. The adenosine deaminase of any one of embodiments 1 or 2, wherein the amino acid sequence of the adenosine deaminase comprises at least 90% sequence identity to SEQ ID NO:2.
4. The adenosine deaminase of any one of embodiments 1 or 2, wherein the amino acid sequence of the adenosine deaminase comprises at least 95% sequence identity to SEQ ID NO: 2.
5. The adenosine deaminase of any one of embodiments 1 or 2, wherein the amino acid sequence of the adenosine deaminase comprises at least 99% sequence identity to SEQ ID NO: 2.
6. The adenosine deaminase of any one of embodiments 1-5, wherein the amino acid sequence comprises the modification at position 82 as numbered in SEQ ID NO: 2, or a corresponding modification in another adenosine deaminase.
7. The adenosine deaminase of any one of embodiments 1-5, wherein the amino acid sequence comprises the modification at position 166 as numbered in SEQ ID NO: 2, or a corresponding modification in another adenosine deaminase.
8. The adenosine deaminase of any one of embodiments 1-5, wherein the amino acid sequence comprises modifications at positions 82 and 166 as numbered in SEQ ID NO: 2, or corresponding modifications in another adenosine deaminase.
9. The adenosine deaminase of any one of embodiments 1-5, wherein the amino acid sequence comprises a V82S modification, wherein position 82 is as numbered in SEQ ID NO: 2.
10. The adenosine deaminase of any one of embodiments 1-5, wherein the amino acid sequence comprises a V82X modification, wherein position 82 is as numbered in SEQ ID NO: 2, wherein X is any amino acid other than V.
11. The adenosine deaminase of any one of embodiments 1-5, wherein the amino acid sequence comprises a T166R modification, wherein position 166 is as numbered in SEQ ID NO: 2.
12. The adenosine deaminase of any one of embodiments 1-5, wherein the amino acid sequence comprises a T166X modification, wherein position 166 is as numbered in SEQ ID NO: 2, wherein X is any amino acid other than T.
13. The adenosine deaminase of any one of embodiments 1-5, wherein the amino acid sequence comprises V82S and T166R modifications, wherein positions 82 and 166 are as numbered in SEQ ID NO: 2.
14. The adenosine deaminase of any one of embodiments 1-13, wherein the amino acid sequence further comprises one or more modifications at positions selected from the group consisting of: 76, 82, 123, 147, 154, and 166, as numbered in SEQ ID NO: 2.
15. The adenosine deaminase of any one of embodiments 1-14, wherein the amino acid sequence further comprises one or more modifications selected from the group consisting of: V82S, Y147T, Y147R, Q154S, Y123H, Q154R, and T166R, as numbered in SEQ ID NO: 2.
16. The adenosine deaminase of any one of embodiments 1-15, wherein the amino acid sequence further comprises a combination of modifications selected from the group consisting of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.
17. The adenosine deaminase of any one of embodiments 1-16, wherein the amino acid sequence further comprises a deletion of a C-terminus beginning at a position selected from the group consisting of 149, 150, 151, 152, 153, 154, 155, 156, and 157, as numbered in SEQ ID NO: 2.
18. The adenosine deaminase of any one of embodiments 1-17, wherein the adenosine deaminase is in a complex with a polynucleotide programmable nucleotide binding domain.
19. The adenosine deaminase of any one of embodiments 1-18, wherein the adenosine deaminase effects a A-to-G modification in a target deoxyribonucleic acid.
20. The adenosine deaminase of any one of embodiments 18 or 19, wherein the complex comprises greater base editing efficiency than a protein complex comprising the polynucleotide programmable nucleotide binding domain and an adenosine deaminase of SEQ ID NO: 2,
21. The adenosine deaminase of any one of embodiments 18-20, wherein the complex comprises at least 50% base editing efficiency.
22. The adenosine deaminase of any one of embodiments 18-21, wherein the complex comprises at least 70% base editing efficiency.
23. The adenosine deaminase of any one of embodiments 18-21, wherein the complex comprises at least five-fold greater base editing efficiency than a protein complex comprising the polynucleotide programmable nucleotide binding domain and an adenosine deaminase of SEQ ID NO: 2.
24. The adenosine deaminase of any one of embodiments 20-23, wherein the base editing efficiency is determined by a percentage of total sequencing reads comprising modification of a target nucleobase effected by the adenosine deaminase.
25. The adenosine deaminase of any one of embodiments 18-24, wherein the complex comprises lower indel formation rate than a protein complex comprising the polynucleotide programmable nucleotide binding domain and an adenosine deaminase of SEQ ID NO: 2.
26. The adenosine deaminase of any one of embodiments 18-25, wherein the complex results in less than 10% indel formation in a target polynucleotide than a protein complex comprising the polynucleotide programmable nucleotide binding domain and an adenosine deaminase of SEQ ID NO: 2.
27. The adenosine deaminase of any one of embodiments 18-26, wherein the complex results in less than 10% indels in a genome in a cell.
28. The adenosine deaminase of any one of embodiments 25-27, wherein the indel formation is measured by mismatch frequency between sequences flanking the target nucleobase modification and an unmodified sequence.
29. The adenosine deaminase of any one of embodiments 18-28, wherein the complex comprises greater specificity for a target nucleobase than a protein complex comprising the polynucleotide programmable nucleotide binding domain and an adenosine deaminase of SEQ ID NO: 2.
30. The adenosine deaminase of any one of embodiments 18-29, wherein the complex results in lower off-target deamination than a protein complex comprising the polynucleotide programmable nucleotide binding domain and an adenosine deaminase of SEQ ID NO: 2.

31. The adenosine deaminase of embodiment 30, wherein the off-target deamination comprises deamination of a spurious nucleobase.
32. The adenosine deaminase of embodiment 30, wherein the off-target deamination comprises deamination of a bystander nucleobase.
33. The adenosine deaminase any one of embodiments 18-32, wherein the complex comprises greater base editing range than a protein complex comprising the polynucleotide programmable nucleotide binding domain and an adenosine deaminase of SEQ ID NO: 2.
34. The adenosine deaminase of any one of embodiments 18-33, wherein the complex comprises: at least 1.5 fold higher base editing efficiency at a target nucleobase that is 5, 6, or 7 base pairs upstream of a canonical PAM sequence, as compared with a protein complex comprising the polynucleotide programmable nucleotide binding domain and an adenosine deaminase of SEQ ID NO: 2.
35. The adenosine deaminase of any one of embodiments 18-34, wherein the complex comprises at least 3 fold higher base editing efficiency at a target nucleobase that is 3, 4, 8, 9, or 10 base pairs upstream of a non-canonical PAM sequence in a target polynucleotide, as compared with a protein complex comprising the polynucleotide programmable nucleotide binding domain and an adenosine deaminase of SEQ ID NO: 2.
36. The adenosine deaminase of any one of embodiments 1-35, wherein the polynucleotide programmable nucleotide binding protein is a Cas9 polypeptide or a fragment thereof.
37. The adenosine deaminase of embodiment 36, wherein the Cas9 polypeptide is a Cas9 nickase (nCas9).
38. The adenosine deaminase of embodiment 36, wherein the Cas9 polypeptide is a nuclease dead Cas9 (dCas9).
39. The adenosine deaminase of any one of embodiments 36-38, wherein the Cas9 polypeptide comprises a SpCas9 polypeptide.
40. The adenosine deaminase of embodiment 39, wherein the SpCas9 polypeptide comprises a D10A and/or a H840A amino acid substitution.
41. The adenosine deaminase of any one of embodiments 36-40, wherein the Cas9 polypeptide comprises a SaCas9 polypeptide.
42. The adenosine deaminase of any one of embodiments 36-41, wherein the Cas9 polypeptide has specificity for an altered PAM.
43. The adenosine deaminase of any one of embodiments 36-42, wherein the Cas9 polypeptide has specificity for a PAM sequence selected from the group consisting of NGG, NGA, NGCG, NGN, NNGRRT, NNNRRT, NGCG, NGCN, NGTN, and NGC, wherein N is A, G, C, or T and wherein R is A or G.
44. A fusion polypeptide comprising:
   a) a polynucleotide programmable nucleotide binding domain;
   b) a adenosine deaminase comprising an amino acid sequence that comprises a modification at an amino acid position 82 or 166 as numbered in SEQ ID NO: 2, or a corresponding modification in another adenosine deaminase, wherein the amino acid sequence of the adenosine deaminase comprises at least 85% sequence identity to SEQ ID NO: 2.
45. A fusion polypeptide, wherein the fusion polypeptide comprises:
   a) a polynucleotide programmable nucleotide binding domain; and
   b) a adenosine deaminase;
   wherein the fusion polypeptide comprises greater base editing efficiency than a second fusion polypeptide comprising the polynucleotide programmable nucleotide binding domain and an adenosine deaminase of SEQ ID NO: 2.
46. The fusion polypeptide of embodiment 45, wherein the fusion polypeptide comprises at least 50% base editing efficiency.
47. The fusion polypeptide of embodiment 45, wherein the fusion polypeptide comprises at least 70% base editing efficiency.
48. The fusion polypeptide of embodiment 45, wherein the fusion polypeptide comprises at least five-fold greater base editing efficiency than a protein complex comprising the polynucleotide programmable nucleotide binding domain and an adenosine deaminase of SEQ ID NO: 2.
49. The fusion polypeptide of any one of embodiments 45-48, wherein the base editing efficiency is determined by a percentage of total sequencing reads comprising modification of a target nucleobase effected by the adenosine deaminase.
50. A fusion polypeptide with reduced indel formation rate, wherein the fusion polypeptide comprises:
   a) a polynucleotide programmable nucleotide binding domain; and
   b) a adenosine deaminase,
   wherein the fusion polypeptide results in lower indel formation in a target polynucleotide sequence as compared to a second fusion polypeptide comprising the polynucleotide programmable nucleotide binding domain and an adenosine deaminase of SEQ ID NO: 2.
51. The fusion polypeptide of embodiment 50, wherein the fusion polypeptide results in less than 5% indel formation in a target polynucleotide sequence as compared to a second fusion polypeptide comprising the polynucleotide programmable nucleotide binding domain and an adenosine deaminase of SEQ ID NO: 2.
52. The fusion polypeptide of any one of embodiments 44-51, wherein the fusion polypeptide results in less than 10% indels in a genome in a cell.
53. The fusion polypeptide of any one of embodiments 51-52, wherein the indel formation is measured by mismatch frequency between sequences flanking the target nucleobase modification and an unmodified sequence.
54. A fusion polypeptide with greater specificity, wherein the fusion polypeptide comprises:
   a) a polynucleotide programmable nucleotide binding domain; and
   b) a adenosine deaminase,
   wherein the fusion polypeptide comprises greater specificity for a target nucleobase than a fusion polypeptide comprising the polynucleotide programmable nucleotide binding domain and an adenosine deaminase of SEQ ID NO: 2.
55. A fusion polypeptide, wherein the fusion polypeptide comprises:
   a) a polynucleotide programmable nucleotide binding domain; and
   b) a adenosine deaminase, wherein the fusion polypeptide results in lower off-target deamination than a fusion polypeptide comprising the polynucleotide programmable nucleotide binding domain and an adenosine deaminase of SEQ ID NO: 2.

56. The fusion polypeptide of embodiment 55, wherein the off-target deamination comprises deamination of a spurious nucleobase.

57. The fusion polypeptide of embodiment 55, wherein the off-target deamination comprises deamination of a bystander nucleobase.

58. A fusion polypeptide, wherein the fusion polypeptide comprises:
   a) a polynucleotide programmable nucleotide binding domain; and
   b) a adenosine deaminase, wherein the fusion polypeptide comprises greater base editing range than a fusion polypeptide comprising the polynucleotide programmable nucleotide binding domain and an adenosine deaminase of SEQ ID NO: 2.

59. The fusion polypeptide of embodiment 58, wherein the fusion polypeptide comprises: at least 1.5 fold higher base editing efficiency at a target nucleobase that is 5, 6, or 7 base pairs upstream of a canonical PAM sequence, as compared with a fusion polypeptide comprising the polynucleotide programmable nucleotide binding domain and an adenosine deaminase of SEQ ID NO: 2.

60. The fusion polypeptide of embodiments 58 or 59, wherein the fusion polypeptide comprises at least 3 fold higher base editing efficiency at a target nucleobase that is 3, 4, 8, 9, or 10 base pairs upstream of a non-canonical PAM sequence in a target polynucleotide, as compared with a fusion polypeptide comprising the polynucleotide programmable nucleotide binding domain and an adenosine deaminase of SEQ ID NO: 2.

61. The fusion polypeptide of any one of embodiments 44-60, wherein the adenosine deaminase deaminates a nucleobase of a deoxyribonucleic acid (DNA) sequence.

62. The fusion polypeptide of any one of embodiments 44-61, wherein the amino acid sequence of the adenosine deaminase comprises at least 90% sequence identity to SEQ ID NO: 2.

63. The fusion polypeptide of any one of embodiments 44-61, wherein the amino acid sequence of the adenosine deaminase comprises at least 95% sequence identity to SEQ ID NO: 2.

64. The fusion polypeptide of any one of embodiments 44-61, wherein the amino acid sequence of the adenosine deaminase comprises at least 99% sequence identity to SEQ ID NO: 2.

65. The fusion polypeptide of any one of embodiments 44-64, wherein the amino acid sequence comprises the modification at position 82 as numbered in SEQ ID NO: 2, or a corresponding modification in another adenosine deaminase.

66. The fusion polypeptide of any one of embodiments 44-64, wherein the amino acid sequence comprises the modification at position 166 as numbered in SEQ ID NO: 2, or a corresponding modification in another adenosine deaminase.

67. The fusion polypeptide of any one of embodiments 44-64, wherein the amino acid sequence comprises modifications at positions 82 and 166 as numbered in SEQ ID NO: 2, or corresponding modifications in another adenosine deaminase.

68. The fusion polypeptide of any one of embodiments 44-64, wherein the amino acid sequence comprises a V82S modification, wherein position 82 is as numbered in SEQ ID NO: 2.

69. The fusion polypeptide of any one of embodiments 44-64, wherein the amino acid sequence comprises a V82X modification, wherein position 82 is as numbered in SEQ ID NO: 2, wherein X is any amino acid other than V.

70. The fusion polypeptide of any one of embodiments 44-64, wherein the amino acid sequence comprises a T166R modification, wherein position 166 is as numbered in SEQ ID NO: 2.

71. The fusion polypeptide of any one of embodiments 44-64, wherein the amino acid sequence comprises a T166X modification, wherein position 166 is as numbered in SEQ ID NO: 2, wherein X is any amino acid other than T.

72. The fusion polypeptide of any one of embodiments 44-64, wherein the amino acid sequence comprises V82S and T166R modifications, wherein positions 82 and 166 are as numbered in SEQ ID NO: 2.

73. The fusion polypeptide of any one of embodiments 44-71, wherein the amino acid sequence further comprises one or more modifications at positions selected from the group consisting of: 76, 82, 123, 147, 154, and 166, as numbered in SEQ ID NO: 2.

74. The fusion polypeptide of any one of embodiments 44-73, wherein the amino acid sequence further comprises one or more modifications selected from the group consisting of: V82S, Y147T, Y147R, Q154S, Y123H, Q154R, and T166R, as numbered in SEQ ID NO: 2.

75. The fusion polypeptide of any one of embodiments 44-74, wherein the amino acid sequence further comprises a combination of modifications selected from the group consisting of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

76. The fusion polypeptide of any one of embodiments 44-75, wherein the amino acid sequence further comprises a deletion of a C-terminus beginning at a position selected from the group consisting of 149, 150, 151, 152, 153, 154, 155, 156, and 157, as numbered in SEQ ID NO: 2.

77. The fusion polypeptide of any one of embodiments 44-76, wherein the adenosine deaminase effects a A-to-G modification in a target deoxyribonucleic acid.

78. The fusion polypeptide of any one of embodiments 44-77, wherein the polynucleotide programmable nucleotide binding domain comprises no substantial nuclease activity.

79. The fusion polypeptide of any one of embodiments 44-78, wherein the polynucleotide programmable nucleotide binding domain comprises a catalytically dead Cas9 (dCas9).

80. The fusion polypeptide of embodiment 79, wherein an indel formation frequency of the fusion polypeptide is lower than a fusion polypeptide comprising a nickase Cas9 and the adenosine deaminase.

81. The fusion polypeptide of embodiment 80, wherein the indel formation frequency is at least about 90% lower than a fusion polypeptide comprising a nickase Cas9 and the adenosine deaminase.

82. The fusion polypeptide of any one of embodiments 44-81, wherein the fusion polypeptide comprises the structure:
   NH2-[N-terminal fragment of the polynucleotide programmable nucleotide binding protein]-[the adenosine deaminase]-[C-terminal fragment of the polynucleotide programmable nucleotide binding protein]-COOH, wherein each instance of "]-[" is an optional linker.
83. The fusion polypeptide of any one of embodiments 44-82, wherein the polynucleotide programmable nucleotide binding protein is a Cas9 polypeptide.
84. The fusion polypeptide of embodiment 83, wherein a C-terminus of the N terminal fragment or an N-terminus of the C terminal fragment comprises a part of a flexible loop of the Cas9 polypeptide.
85. The fusion polypeptide of embodiments 83 or 84, wherein the Cas9 polypeptide is a Cas9 nickase (nCas9).
86. The fusion polypeptide of embodiments 83 or 84, wherein the Cas9 polypeptide is a nuclease dead Cas9 (dCas9).
87. The fusion polypeptide of any one of embodiments 83-86, wherein the Cas9 polypeptide comprises a SpCas9 polypeptide.
88. The fusion polypeptide of embodiment 87, wherein the SpCas9 polypeptide comprises a D10A and/or a H840A amino acid substitution.
89. The fusion polypeptide of any one of embodiments 83-88, wherein the Cas9 polypeptide comprises a SaCas9 polypeptide.
90. The fusion polypeptide of any one of embodiments 83-89, wherein the Cas9 polypeptide has specificity for an altered PAM.
91. The fusion polypeptide of any one of embodiments 83-90, wherein the Cas9 polypeptide has specificity for a PAM sequence selected from the group consisting of NGG, NGA, NGCG, NGN, NNGRRT, NNNRRT, NGCG, NGCN, NGTN, and NGC, wherein N is A, G, C, or T and wherein R is A or G.
92. An adenosine deaminase dimer comprising:
  a) a first adenosine deaminase monomer comprising the adenosine deaminase of any one of embodiments 1-43; and
  b) a second adenosine deaminase monomer.
93. The adenosine deaminase dimer of embodiment 92, wherein the second adenosine deaminase monomer comprises an amino acid sequence of SEQ ID NO: 2.
94. The adenosine deaminase dimer of embodiments 92 or 93, wherein the second adenosine deaminase monomer comprises an amino acid sequence of a wild-type adenosine deaminase.
95. The adenosine deaminase dimer of any one of embodiments 92-94, wherein the second adenosine deaminase monomer comprises an amino acid sequence that comprises a modification at position 82 or 166 as numbered in SEQ ID NO: 2, or a corresponding modification in another adenosine deaminase monomer.
96. The adenosine deaminase dimer of any one of embodiments 92-95, wherein the second adenosine deaminase monomer comprises an amino acid sequence that is the same as the amino acid sequence of the first adenosine deaminase monomer.
97. A base-editor system comprising:
  a) a polynucleotide programmable nucleotide binding domain; and
  b) the adenosine deaminase of any one of embodiments 1-43.
98. A method for editing a target nucleobase in a target polynucleotide sequence, the method comprising: contacting the target polynucleotide sequence with the adenosine deaminase of any one of embodiments 1-43, wherein the adenosine deaminase deaminates the target nucleobase in the target polynucleotide sequence, thereby editing the target nucleobase in the target polynucleotide sequence.
99. A method for editing a target nucleobase in a target polynucleotide sequence, the method comprising: contacting the target polynucleotide sequence with the fusion polypeptide of any one of embodiments 44-91, wherein the adenosine deaminase deaminates the target nucleobase in the target polynucleotide sequence, thereby editing the target nucleobase in the target polynucleotide sequence.
100. A method for editing a target nucleobase in a target polynucleotide sequence, the method comprising: contacting the target polynucleotide sequence with the base editor system of embodiment 97, wherein the adenosine deaminase deaminates the target nucleobase in the target polynucleotide sequence, thereby editing the target nucleobase in the target polynucleotide sequence.
101. A method of treating a disorder in a subject in need thereof, the method comprising: contacting a target polynucleotide sequence of the subject with the adenosine deaminase of any one of embodiments 1-43, wherein the adenosine deaminase deaminates a target nucleobase in the target polynucleotide sequence, thereby treating the disorder in the subject.
102. A method of treating a disorder in a subject in need thereof, the method comprising: contacting a target polynucleotide sequence of the subject with the fusion polypeptide of any one of embodiments 44-91, wherein the adenosine deaminase deaminates a target nucleobase in the target polynucleotide sequence, thereby treating the disorder in the subject.
103. A method of treating a disorder in a subject in need thereof, the method comprising: contacting a target polynucleotide sequence of the subject with a base editor system of embodiment 97, wherein the adenosine deaminase deaminates a target nucleobase in the target polynucleotide sequence, thereby treating the disorder in the subject.
104. The method of any one of embodiments 101-103, wherein the disorder results from a point mutation.
105. The method of embodiment 104, wherein the point mutation is a G to A point mutation.
106. The method of embodiment 105, wherein the target nucleobase is the mutant A base.
107. The method of embodiment 106, wherein the deamination of the mutant A base results in a sequence that is not associated with a disorder.
108. The method of any one of embodiments 98-107, wherein the deamination of the target nucleobase results in a change of an amino acid codon encoded by the target polynucleotide.
109. The method of any one of embodiments 98-107, wherein the deamination results in the introduction of a splice site.
110. The method of any one of embodiments 98-107, wherein the deamination results in the removal of a splice site.
111. The method of any one of embodiments 98-107, wherein the deamination results in the removal of a stop codon.
112. The method of any one of embodiments 98-107, wherein the deamination results in the introduction of a modification in a gene promoter sequence.
113. The method of embodiment 112, wherein the modification leads to an increase in the transcription of a gene operably linked to the gene promoter sequence.

114. The method of embodiment 112, wherein the modification leads to a decrease in the transcription of a gene operably linked to the gene promoter sequence.
115. The method of any one of embodiments 98-107, wherein the deamination results in the introduction of a modification in a gene repressor sequence.
116. The method of embodiment 115, wherein the modification leads to an increase in the transcription of a gene operably linked to the gene repressor sequence.
117. The method of embodiment 115, wherein the modification leads to a decrease in the transcription of a gene operably linked to the gene repressor sequence.
118. The method of any one of embodiments 98-117, wherein the contacting occurs in vivo.
119. The method of any one of embodiments 98-117, wherein the contacting occurs ex vivo.
120. The method of any one of embodiments 98-117, wherein the contacting is in a cell.
121. The method of embodiment 120, wherein the method results in less than 15% indels in a genome of the cell.
122. The method of embodiment 120, wherein the method results in less than 5% indels in a genome of the cell.
123. The method of embodiment 120, wherein the method results in less than 2% indels in a genome of the cell.
124. The method of any one of embodiments 120-123, wherein the cell is a mammalian cell or a human cell.
125. The method of any one of embodiments 98-117, wherein the contacting is in a population of cells.
126. The method of embodiment 125, wherein at least 40% of the population of cells comprise the deaminated target nucleobase after the contacting.
127. The method of embodiment 125, wherein at least 50% of the population of cells comprise the deaminated target nucleobase after the contacting.
128. The method of embodiment 125, wherein at least 60% of the population of cells comprise the deaminated target nucleobase after the contacting.
129. The method of any one of embodiments 125-128, wherein at least 85% of the population of cells are viable after the contacting.
130. The method of any one of embodiments 125-129, wherein the population of cells are mammalian cells or human cells.
131. The method of any one of embodiments 98-130, wherein the adenosine deaminase effects a A-to-G modification in a target deoxyribonucleic acid.
132. The method of any one of embodiments 98-131, wherein the method results in greater base editing efficiency than a method using an adenosine deaminase of SEQ ID NO: 2.
133. The method of any one of embodiments 98-132, wherein the method results in at least five-fold greater base editing efficiency than a method using an adenosine deaminase of SEQ ID NO: 2.
134. The method of any one of embodiments 98-133, wherein the method results in at least 50% base editing efficiency.
135. The method of any one of embodiments 98-133, wherein the method results in at least 70% base editing efficiency.
136. The method of any one of embodiments 98-135, wherein the method results in lower indel formation rate than a method using an adenosine deaminase of SEQ ID NO: 2.
137. The method of any one of embodiments 98-135, wherein the method results in greater specificity for a target nucleobase than a method using an adenosine deaminase of SEQ ID NO: 2.
138. The method of any one of embodiments 98-135, wherein the method results in lower off-target deamination than a method using an adenosine deaminase of SEQ ID NO: 2.
139. The method of any one of embodiments 99-138, further comprising contacting the target polynucleotide sequence with a guide polynucleotide, wherein the guide polynucleotide directs the fusion polypeptide to effect the deamination of the target nucleobase.
140. The method of embodiment 139, wherein the guide polynucleotide comprises a nucleic acid sequence that hybridizes with the target polynucleotide sequence.

SEQUENCE LISTING (395 sequences)

SEQ ID NO: 1 - protein, 1368 aa, Streptococcus pyogenes [sequence omitted]

SEQ ID NO: 2 - protein, 167 aa, Escherichia coli
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 3 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 4 - protein, 166 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSST

SEQ ID NO: 5 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 6 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 7 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 8 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 9 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 10 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 11 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 12 - protein, 1410 aa, Artificial Sequence
  Description of Artificial Sequence: Synthetic polypeptide
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 13 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTD

SEQ ID NO: 14 - protein, 24 aa, Artificial Sequence
  Description of Artificial Sequence: Synthetic peptide
SGGSSGGSSGSETPGTSESATPES

SEQ ID NO: 15 - protein, 1052 aa, Artificial Sequence
  Description of Artificial Sequence: Synthetic polypeptide
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 16 - RNA, 20 nt, Artificial Sequence
  Description of Artificial Sequence: Synthetic oligonucleotide
gaccuaggcgaggcaguagg

SEQ ID NO: 17 - RNA, 21 nt, Artificial Sequence
  Description of Artificial Sequence: Synthetic oligonucleotide
ccaguauggacacuguccaaa

SEQ ID NO: 18 - RNA, 20 nt, Artificial Sequence
  Description of Artificial Sequence: Synthetic oligonucleotide
caguauggacacuguccaaa

SEQ ID NO: 19 - RNA, 20 nt, Artificial Sequence
  Description of Artificial Sequence: Synthetic oligonucleotide
aguauggacacuguccaaag

SEQ ID NO: 20 - RNA, 125 nt, Artificial Sequence
  Description of Artificial Sequence: Synthetic polynucleotide
guuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 21 - protein, 304 aa, Homo sapiens
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 22 - protein, 313 aa, Homo sapiens
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 23 - protein, 167 aa, Escherichia coli; identical to SEQ ID NO: 3

SEQ ID NO: 24 - DNA, 8877 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 25 - DNA, 5508 bp, Artificial Sequence
  Description of Artificial Sequence: Synthetic polynucleotide
atgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagccgcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctaaaaggacggcggacggatcagagttcgagagtccgaaaaaaaaacgaaaggtcgaataa

SEQ ID NO: 26 - DNA, 5514 bp, Artificial Sequence
  Description of Artificial Sequence: Synthetic polynucleotide
atgtcatccgaaaccgggccagtggccgtagacccaacactcaggaggcggatagaaccccatgagtttgaagtgttcttcgaccccagagagctgcgcaaagagacttgcctcctgtatgaaataaattgggggggtcgccattcaatttggaggcacactagccagaatactaacaaacacgtggaggtaaattttatcgagaagtttaccaccgaaagatacttttgccccaatacacggtgttcaattacctggtttctgtcatggagtccatgtggagaatgtagtagagcgataactgagttcctgtctcgatatcctcacgtcacgttgtttatatacatcgctcggctttatcaccatgcggacccgcggaacaggcaaggtcttcgggacctcatatcctctggggtgaccatccagataatgacggagcaagagagcggatactgctggcgaaactttgttaactacagcccaagcaatgaggcacactggcctagatatccgcatctctgggttcgactgtatgtccttgaactgtactgcataattctgggacttccgccatgcttgaacattctgcggcggaaacaaccacagctgacctttttcacgattgctctccaaagttgtcactaccagcgattgccaccccacatcttgtgggctactggactcaagtctggaggaagttcaggcggaagcagcgggtctgaaacgcccggaacctcagagagcgcaacgcccgaaagctctggagggtcaagtggtggtagtgataagaaatactccatcggcctcgccatcggtacgaattctgtcggttgggccgttatcaccgatgagtacaaggtcccttctaagaaattcaaggttttgggcaatacagaccgccattctataaaaaaaaacctgatcggcgcccttttgtttgacagtggtgagactgctgaagcgactcgcctgaagcgaactgccaggaggcggtatacgaggcgaaaaaaccgaatttgttacctccaggagattttctcaaatgaaatggccaaggtagatgatagtttttttcaccgcttggaagaaagttttctcgttgaggaggacaaaaagcacgagaggcacccaatctttggcaacatagtcgatgaggtcgcataccatgagaaatatcctacgatctatcatctccgcaagaagctggtcgatagcacggataaagctgacctccggctgatctaccttgctcttgctcacatgattaaattcaggggccatttcctgatagaaggagacctcaatcccgacaattctgatgtcgacaaactgtttattcagctcgttcagacctataatcaactctttgaggagaaccccatcaatgcttcaggggtggacgcaaaggccattttgtccgcgcgcttgagtaaatcacgacgcctcgagaatttgatagctcaactgccgggtgagaagaaaaacgggttgtttgggaatctcatagcgttgagtttgggacttacgccaaactttaagtctaactttgatttggccgaagatgccaaattgcagctgtccaaagatacctatgatgacgacttggataaccttcttgcgcagattggtgaccaatacgcggatctgtttcttgccgcaaaaaatctgtccgacgccatactcttgtccgatatactgcgcgtcaatactgagataactaaggctcccctcagcgcgtccatgattaaaagatacgatgagcaccaccaagatctcactctgttgaaagccctggttcgccagcagcttccagagaagtataaggagatatttttcgaccaatctaaaaacggctatgcgggttacattgacggtggcgcctctcaagaagaattctacaagtttataaagccgatacttgagaaaatggacggtacagaggaattgttggttaagctcaatcgcgaggacttgttgagaaagcagcgcacatttgacaatggtagtattccacaccagattcatctgggcgagttgcatgccattcttagaagacaagaagatttttatccgtttctgaaagataacagagaaaagattgaaaagatacttacctttcgcataccgtattatgtaggtcccctggctagagggaacagtcgcttcgcttggatgactcgaaaatcagaagaaacaataaccccctggaattttgaagaagtggtagataaaggtgcgagtgcccaatcttttattgagcggatgacaaattttgacaagaatctgcctaacgaaaaggtgcttcccaagcattcccttttgtatgaatactttacagtatataatgaactgactaaagtgaagtacgttaccgaggggatgcgaaagccagcttttctcagtggcgagcagaaaaaagcaatagttgacctgctgttcaagacgaataggaaggttaccgtcaaacagctcaaagaagattactttaaaaagatcgaatgttttgattcagttgagataagcggagtagaggatagatttaacgcaagtcttggaacttatcatgaccttttgaagatcatcaaggataaagattttttggacaacgaggagaatgaagatatcctggaagatatagtacttaccttgacgctttttgaagatcgagagatgatcgaggagcgacttaagacgtacgcacatctctttgacgataaggttatgaaacaattgaaacgccggcggtatactggctggggcaggctttctcgaaagctgattaatggtatccgcgataagcagtctggaaagacaatccttgactttctgaaaagtgatggatttgcaaatagaaactttatgcagcttatacatgatgactctttgacgttcaaggaagacatccagaaggcacaggtatccggccaaggggatagcctccatgaacacatagccaacctggccggctcaccagctattaaaaagggaatattgcaaaccgttaaggttgttgacgaactcgttaaggttatgggccgacacaaaccagagaatatcgtgattgagatggctagggagaatcagaccactcaaaaaggtcagaaaaattctcgcgaaaggatgaagcgaattgaagagggaatcaaagaacttggctctcaaattttgaaagagcacccggtagaaaacactcagctgcagaatgaaaagctgtatctgtattatctgcagaatggtcgagatatgtacgttgatcaggagctggatatcaataggctcagtgactacgatgtcgaccacatcgttcctcaatctttcctgaaagatgactctatcgacaacaaagtgttgacgcgatcagataagaaccggggaaaatccgacaatgtaccctcagaagaagttgtcaagaagatgaaaaactattggagacaattgctgaacgccaagctcataacacaacgcaagttcgataacttgacgaaagccgaaagaggtgggttgtcagaattggacaaagctggctttattaagcgccaattggtggagacccggcagattacgaaacacgtagcacaaattttggattcacgaatgaataccaaatacgacgaaaacgacaaattgatacgcgaggtgaaagtgattacgcttaagagtaagttggtttccgatttcaggaaggattttcagttttacaaagtaagagaaataaacaactaccaccacgcccatgatgcttacctcaacgcggtagttggcacagctcttatcaaaaaatatccaaagctggaaagcgagttcgtttacggtgactataaagtatacgacgttcggaagatgatagccaaatcagagcaggaaattgggaaggcaaccgcaaaatacttcttctattcaaacatcatgaacttctttaagacggagattacgctcgcgaacggcgaaatacgcaagaggcccctcatagagactaacggcgaaaccggggagatcgtatgggacaaaggacgggactttgcgaccgttagaaaagtactttcaatgccacaagtgaatattgttaaaaagacagaagtacaaacaggggggttcagtaaggaatccattttgcccaagcggaacagtgataaattgatagcaaggaaaaaagattgggaccctaagaagtacggtggtttcgactctcctaccgttgcatattcagtccttgtagttgcgaaagtggaaaaggggaaaagtaagaagcttaagagtgttaaagagcttctgggcataaccataatggaacggtctagcttcgagaaaaatccaattgactttctcgaggctaaaggttacaaggaggtaaaaaaggacctgataattaaactcccaaagtacagtctcttcgagttggagaatgggaggaagagaatgttggcatctgcaggggagctccaaaaggggaacgagctggctctgccttcaaaatacgtgaactttctgtacctggccagccactacgagaaactcaagggttctcctgaggataacgagcagaaacagctgtttgtagagcagcacaagcattacctggacgagataattgagcaaattagtgagttctcaaaaagagtaatccttgcagacgcgaatctggataaagttctttccgcctataataagcaccgggacaagcctatacgagaacaagccgagaacatcattcacctctttacccttactaatctgggcgcgccggccgccttcaaatacttcgacaccacgatagacaggaaaaggtatacgagtaccaaagaagtacttgacgccactctcatccaccagtctataacagggttgtacgaaacgaggatagatttgtcccagctcggcggcgactcaggagggtcaggcggctccggtggatcaacgaatctttccgacataatcgagaaagaaaccggcaaacagttggtgatccaagaatcaatcctgatgctgcctgaagaagtagaagaggtgattggcaacaaacctgagtctgacattcttgtccacaccgcgtatgacgagagcacggacgagaacgttatgcttctcactagcgacgcccctgagtataaaccatgggcgctggtcatccaagattccaatggggaaaacaagattaagatgcttagtggtgggtctggagggagcggtgggtccacgaacctcagcgacattattgaaaaagagactggtaaacaacttgtaatacaagagtctattctgatgttgcctgaagaggtggaggaggtgattgggaacaaaccggagtctgatatacttgttcataccgcctatgacgaatctactgatgagaatgtgatgcttttaacgtcagacgctcccgagtacaaaccctgggctctggtgattcaggacagcaatggtgagaataagattaaaatgttgagtgggggctcaaagcgcacggctgacggtagcgaatttgagagccccaaaaaaaaacgaaaggtcgaataa

SEQ ID NO: 27 - DNA, 5514 bp, Artificial Sequence
  Description of Artificial Sequence: Synthetic polynucleotide
atgagcagcgagacaggccctgtggctgtggatcctacactgcggagaagaatcgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggactgcgcgacctgatcagcagcggagtgaccatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagagcggaggatctagcggcggctctagcggatctgagacacctggcacaagcgagtctgccacacctgagagtagcggcggatcttctggcggctccgacaagaagtactctatcggactggccatcggcaccaactctgttggatgggccgtgatcaccgacgagtacaaggtgcccagcaagaaattcaaggtgctgggcaacaccgaccggcacagcatcaagaagaatctgatcggcgccctgctgttcgactctggcgaaacagccgaagccaccagactgaagagaaccgccaggcggagatacacccggcggaagaaccggatctgctacctgcaagagatcttcagcaacgagatggccaaggtggacgacagcttcttccacagactggaagagtccttcctggtggaagaggacaagaagcacgagcggcaccccatcttcggcaacatcgtggatgaggtggcctaccacgagaagtaccccaccatctaccacctgagaaagaaactggtggacagcaccgacaaggccgacctgagactgatctacctggctctggcccacatgatcaagttccggggccactttctgatcgagggcgatctgaaccccgacaacagcgacgtggacaagctgttcatccagctggtgcagacctacaaccagctgttcgaggaaaaccccatcaacgcctctggcgtggacgccaaggctatcctgtctgccagactgagcaagagcagaaggctggaaaacctgatcgcccagctgcctggcgagaagaagaatggcctgttcggcaacctgattgccctgagcctgggactgacccctaacttcaagagcaacttcgacctggccgaggatgccaaactgcagctgagcaaggacacctacgacgacgacctggacaatctgctggcccagatcggcgatcagtacgccgacttgtttctggccgccaagaacctgtccgacgccatcctgctgagcgatatcctgagagtgaacaccgagatcacaaaggcccctctgagcgcctctatgatcaagagatacgacgagcaccaccaggatctgaccctgctgaaggccctcgttagacagcagctgccagagaagtacaaagagattttcttcgatcagtccaagaacggctacgccggctacattgatggcggagccagccaagaggaattctacaagttcatcaagcccatcctggaaaagatggacggcaccgaggaactgctggtcaagctgaacagagaggacctgctgcggaagcagcggaccttcgacaatggctctatccctcaccagatccacctgggagagctgcacgccattctgcggagacaagaggacttttacccattcctgaaggacaaccgggaaaagatcgagaagatcctgaccttcaggatcccctactacgtgggaccactggccagaggcaatagcagattcgcctggatgaccagaaagagcgaggaaaccatcacaccctggaacttcgaggaagtggtggacaagggcgccagcgctcagtccttcatcgagcggatgaccaacttcgataagaacctgcctaacgagaaggtgctgcccaagcactccctgctgtatgagtacttcaccgtgtacaacgagctgaccaaagtgaaatacgtgaccgagggaatgagaaagcccgcctttctgagcggcgagcagaaaaaggccattgtggatctgctgttcaagaccaaccggaaagtgaccgtgaagcagctgaaagaggactacttcaagaaaatcgagtgcttcgacagcgtggaaatcagcggcgtggaagatcggttcaatgccagcctgggcacataccacgacctgctgaaaattatcaaggacaaggacttcctggacaacgaagagaacgaggacattctcgaggacatcgtgctgaccctgacactgtttgaggacagagagatgatcgaggaacggctgaaaacatacgcccacctgttcgacgacaaagtgatgaagcaactgaagcggaggcggtacacaggctggggcagactgtctcggaagctgatcaacggcatccgggataagcagtccggcaagacaatcctggatttcctgaagtccgacggcttcgccaacagaaacttcatgcagctgatccacgacgacagcctgacctttaaagaggacatccagaaagcccaggtgtccggccaaggcgattctctgcacgagcacattgccaacctggccggatctcccgccattaagaagggcatcctgcagacagtgaaggtggtggacgagcttgtgaaagtgatgggcagacacaagcccgagaacatcgtgatcgaaatggccagagagaaccagaccacacagaagggccagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaaccggctgagcgactacgatgtggaccatatcgtgccccagagctttctgaaggacgactccatcgataacaaggtcctgaccagaagcgacaagaaccggggcaagagcgataacgtgccctccgaagaggtggtcaagaagatgaagaactactggcgacagctgctgaacgccaagctgattacccagcggaagttcgataacctgaccaaggccgagagaggcggcctgagcgaacttgataaggccggcttcattaagcggcagctggtggaaacccggcagatcaccaaacacgtggcacagattctggactcccggatgaacactaagtacgacgagaatgacaagctgatccgggaagtgaaagtcatcaccctgaagtctaagctggtgtccgatttccggaaggatttccagttctacaaagtgcgggaaatcaacaactaccatcacgcccacgacgcctacctgaatgccgttgttggaacagccctgatcaagaagtatcccaagctggaaagcgagttcgtgtacggcgactacaaggtgtacgacgtgcggaagatgatcgccaagagcgaacaagagatcggcaaggctaccgccaagtactttttctacagcaacatcatgaactttttcaagacagagatcaccctggccaacggcgagatccggaaaagacccctgatcgagacaaacggcgaaaccggggagatcgtgtgggataagggcagagattttgccacagtgcggaaagtgctgagcatgccccaagtgaatatcgtgaagaaaaccgaggtgcagacaggcggcttcagcaaagagtctatcctgcctaagcggaacagcgataagctgatcgccagaaagaaggactgggaccctaagaagtacggcggcttcgatagccctaccgtggcctattctgtgctggtggtggccaaagtggaaaagggcaagtccaaaaagctcaagagcgtgaaagagctgctggggatcaccatcatggaaagaagcagctttgagaagaacccgatcgactttctggaagccaagggctacaaagaagtcaagaaggacctcatcatcaagctccccaagtacagcctgttcgagctggaaaatggccggaagcggatgctggcctcagcaggcgaactgcagaaaggcaatgaactggccctgcctagcaaatacgtcaacttcctgtacctggccagccactatgagaagctgaagggcagccccgaggacaatgagcaaaagcagctgtttgtggaacagcacaagcactacctggacgagatcatcgagcagatcagcgagttctccaagagagtgatcctggccgacgctaacctggataaggtgctgtctgcctataacaagcaccgggacaagcctatcagagagcaggccgagaatatcatccacctgtttaccctgaccaacctgggagcccctgccgccttcaagtacttcgacaccaccatcgaccggaagaggtacaccagcaccaaagaggtgctggacgccacactgatccaccagtctatcaccggcctgtacgaaacccggatcgacctgtctcagctcggcggcgattctggtggttctggcggaagtggcggatccaccaatctgagcgacatcatcgaaaaagagacaggcaagcagctcgtgatccaagaatccatcctgatgctgcctgaagaggttgaggaagtgatcggcaacaagcctgagtccgacatcctggtgcacaccgcctacgatgagagcaccgatgagaacgtcatgctgctgacaagcgacgcccctgagtacaagccttgggctctcgtgattcaggacagcaatggggagaacaagatcaagatgctgagcggaggtagcggaggcagtggcggaagcacaaacctgtctgatatcattgaaaaagaaaccgggaagcaactggtcattcaagagtccattctcatgctcccggaagaagtcgaggaagtcattggaaacaaacccgagagcgatattctggtccacacagcctatgacgagtctacagacgaaaacgtgatgctcctgacctctgacgctcccgagtataagccctgggcacttgttatccaggactctaacggggaaaacaaaatcaaaatgttgtccggcggcagcaagcggacagccgatggatctgagttcgagagccccaagaagaaacggaaggtggagtaa

SEQ ID NO: 28 - DNA, 8811 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 29 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 30 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 31 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 32 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 34 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 35 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 36 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 41 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 42 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 43 - protein, 986 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 44 - protein, 1210 aa, Unknown
  Description of Unknown: uncultured Parcubacteria group bacterium sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 45 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 46 - DNA, 306 bp, Artificial Sequence
  Description of Artificial Sequence: Synthetic polynucleotide
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 47 - protein, 102 aa, Artificial Sequence
  Description of Artificial Sequence: Synthetic polypeptide
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 48 - DNA, 108 bp, Artificial Sequence
  Description of Artificial Sequence: Synthetic polynucleotide
atgatcaagatagctacaaggaagtatcttggcaaacaaaacgtttatgatattggagtcgaaagagatcacaactttgctctgaagaacggattcatagcttctaat

SEQ ID NO: 49 - protein, 36 aa, Artificial Sequence
  Description of Artificial Sequence: Synthetic polypeptide
MIKIATRKYLGKQNVYDIGVERDHNFALKNGFIASN

SEQ ID NO: 50 - DNA, 303 bp, Artificial Sequence
  Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 51 - protein, 101 aa, Artificial Sequence
  Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 52 - DNA, 159 bp, Artificial Sequence
  Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 53 - protein, 53 aa, Artificial Sequence
  Description of Artificial Sequence: Synthetic polypeptide
MKRTADGSEFESPKKKRKVKIISRKSLGTQNVYDIGVEKDHNFLLKNGLVASN

SEQ ID NO: 54 - protein, 24 aa, Artificial Sequence
  Description of Artificial Sequence: Synthetic peptide
SGGSSGSETPGTSESATPESSGGS

SEQ ID NO: 55 - protein, 32 aa, Artificial Sequence
  Description of Artificial Sequence: Synthetic polypeptide
SGGSSGGSSGSETPGTSESATPESSGGSSGGS

SEQ ID NO: 56 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 57 - protein, 4 aa, Artificial Sequence
  Description of Artificial Sequence: Synthetic peptide
SGGS

SEQ ID NO: 58 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 59 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 60 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 61 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 62 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 63 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 64 - protein, 16 aa, Artificial Sequence
  Description of Artificial Sequence: Synthetic peptide
SGSETPGTSESATPES

SEQ ID NO: 65 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units
XPXPXPXPXPXPXPXPXPXPXPXPXPXPXPXPXPXPXPXPXPXPXPXPXPXPXPXPXPXP

SEQ ID NO: 66 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 67 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 68 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 69 - protein, 18 aa, Artificial Sequence
  Description of Artificial Sequence: Synthetic peptide
KRTADGSEFESPKKKRKV

SEQ ID NO: 70 - protein, 16 aa, Artificial Sequence
  Description of Artificial Sequence: Synthetic peptide
KRPAATKKAGQAKKKK

SEQ ID NO: 71 - protein, 17 aa, Artificial Sequence
  Description of Artificial Sequence: Synthetic peptide
KKTELQTTNAENKTKKL

SEQ ID NO: 72 - protein, 19 aa, Artificial Sequence
  Description of Artificial Sequence: Synthetic peptide
KRGINDRNFWRGENGRKTR

SEQ ID NO: 73 - protein, 16 aa, Artificial Sequence
  Description of Artificial Sequence: Synthetic peptide
RKSGKIAAIVVKRPRK

SEQ ID NO: 74 - protein, 7 aa, Artificial Sequence
  Description of Artificial Sequence: Synthetic peptide
PKKKRKV

SEQ ID NO: 75 - protein, 30 aa, Artificial Sequence
  Description of Artificial Sequence: Synthetic polypeptide
MDSLLMNRRKFLYQFKNVRWAKGRRETYLC

SEQ ID NO: 76 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 77 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 78 - protein, 1368 aa, Artificial Sequence; identical to SEQ ID NO: 32
  Description of Artificial Sequence: Synthetic polypeptide

SEQ ID NO: 79 - protein, 987 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 80 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 81 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 82 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 83 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 84 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 85 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 86 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 87 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 88 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 89 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 90 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 91 - protein, 1129 aa, Alicyclobacillus acidiphilus
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 92 - DNA, 47 bp, Artificial Sequence
  Description of Artificial Sequence: Synthetic oligonucleotide
gggaaataagagagaaaagaagagtaagaagaaatataagagccacc

SEQ ID NO: 93 - DNA, 101 bp, Artificial Sequence
  Description of Artificial Sequence: Synthetic polynucleotide
gctggagcctcggtggccatgcttcttgccccttgggcctccccccagcccctcctccccttcctgcacccgtacccccgtggtctttgaataaagtctga

SEQ ID NO: 94 - DNA, 3420 bp, Artificial Sequence
  Description of Artificial Sequence: Synthetic polynucleotide
atggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaag

SEQ ID NO: 95 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 96 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 97 - protein, 1302 aa, Artificial Sequence
  Description of Artificial Sequence: Synthetic polypeptide
MQTKKTHLHLISAKASRKYRRTIACLSDTAKKDLERRKQSGAADPAQELSCLKTIKFKLEVPEGSKLPSFDRISQIYNALETIEKGSLSYLLFALILSGFRIFPNSSAAKTFASSSCYKNDQFASQIKEIFGEMVKNFIPSELESILKKGRRKNNKDWTEENIKRVLNSEFGRKNSEGSSALFDSFLSKFSQELFRKFDSWNEVNKKYLEAAELLDSMLASYGPFDSVCKMIGDSDSRNSLPDKSTIAFTNNAEITVDIESSVMPYMAIAALLREYRQSKSKAAPVAYVQSHLTTTNGNGLSWFFKFGLDLIRKAPVSSKQSTSDGSKSLQELFSVPDDKLDGLKFIKEACEALPEASLLCGEKGELLGYQDFRTSFAGHIDSWVANYVNRLFELIELVNQLPESIKLPSILTQKNHNLVASLGLQEAEVSHSLELFEGLVKNVRQTLKKLAGIDISSSPNEQDIKEFYAFSDVLNRLGSIRNQIENAVQTAKKDKIDLESAIEWKEWKKLKKLPKLNGLGGGVPKQQELLDKALESVKQIRHYQRIDFERVIQWAVNEHCLETVPKFLVDAEKKKINKESSTDFAAKENAVRFLLEGIGAAARGKTDSVSKAAYNWFVVNNFLAKKDLNRYFINCQGCIYKPPYSKRRSLAFALRSDNKDTIEVVWEKFETFYKEISKEIEKFNIFSQEFQTFLHLENLRMKLLLRRIQKPIPAEIAFFSLPQEYYDSLPPNVAFLALNQEITPSEYITQFNLYSSFLNGNLILLRRSRSYLRAKFSWVGNSKLIYAAKEARLWKIPNAYWKSDEWKMILDSNVLVFDKAGNVLPAPTLKKVCEREGDLRLFYPLLRQLPHDWCYRNPFVKSVGREKNVIEVNKEGEPKVASALPGSLFRLIGPAPFKSLLDDCFFNPLDKDLRECMLIVDQEISQKVEAQKVEASLESCTYSIAVPIRYHLEEPKVSNQFENVLAIDQGEAGLAYAVFSLKSIGEAETKPIAVGTIRIPSIRRLIHSVSTYRKKKQRLQNFKQNYDSTAFIMRENVTGDVCAKIVGLMKEFNAFPVLEYDVKNLESGSRQLSAVYKAVNSHFLYFKEPGRDALRKQLWYGGDSWTIDGIEIVTRERKEDGKEGVEKIVPLKVFPGRSVSARFTSKTCSCCGRNVFDWLFTEKKAKTNKKFNVNSKGELTTADGVIQLFEADRSKGPKFYARRKERTPLTKPIAKGSYSLEEIERRVRTNLRRAPKSKQSRDTSQSQYFCVYKDCALHFSGMQADENAAINIGRRFLTALRKNRRSDFPSNVKISDRLLDN

SEQ ID NO: 98 - protein, 1218 aa, Artificial Sequence
  Description of Artificial Sequence: Synthetic polypeptide
MTKHSIPLHAFRNSGADARKWKGRIALLAKRGKETMRTLQFPLEMSEPEAAAINTTPFAVAYNAIEGTGKGTLFDYWAKLHLAGFRFFPSGGAATIFRQQAVFEDASWNAAFCQQSGKDWPWLVPSKLYERFTKAPREVAKKDGSKKSIEFTQENVANESHVSLVGASITDKTPEDQKEFFLKMAGALAEKFDSWKSANEDRIVAMKVIDEFLKSEGLHLPSLENIAVKCSVETKPDNATVAWHDAPMSGVQNLAIGVFATCASRIDNIYDLNGGKLSKLIQESATTPNVTALSWLFGKGLEYFRTTDIDTIMQDFNIPASAKESIKPLVESAQAIPTMTVLGKKNYAPFRPNFGGKIDSWIANYASRLMLLNDILEQIEPGFELPQALLDNETLMSGIDMTGDELKELIEAVYAWVDAAKQGLATLLGRGGNVDDAVQTFEQFSAMMDTLNGTLNTISARYVRAVEMAGKDEARLEKLIECKFDIPKWCKSVPKLVGISGGLPKVEEEIKVMNAAFKDVRARMFVRFEEIAAYVASKGAGMDVYDALEKRELEQIKKLKSAVPERAHIQAYRAVLHRIGRAVQNCSEKTKQLFSSKVIEMGVFKNPSHLNNFIFNQKGAIYRSPFDRSRHAPYQLHADKLLKNDWLELLAEISATLMASESTEQMEDALRLERTRLQLQLSGLPDWEYPASLAKPDIEVEIQTALKMQLAKDTVTSDVLQRAFNLYSSVLSGLTFKLLRRSFSLKMRFSVADTTQLIYVPKVCDWAIPKQYLQAEGEIGIAARVVTESSPAKMVTEVEMKEPKALGHFMQQAPHDWYFDASLGGTQVAGRIVEKGKEVGKERKLVGYRMRGNSAYKTVLDKSLVGNTELSQCSMIIEIPYTQTVDADFRAQVQAGLPKVSINLPVKETITASNKDEQMLFDRFVAIDLGERGLGYAVFDAKTLELQESGHRPIKAITNLLNRTHHYEQRPNQRQKFQAKFNVNLSELRENTVGDVCHQINRICAYYNAFPVLEYMVPDRLDKQLKSVYESVTNRYIWSSTDAHKSARVQFWLGGETWEHPYLKSAKDKKPLVLSPGRGASGKGTSQTCSCCGRNPFDLIKDMKPRAKIAVVDGKAKLENSELKLFERNLESKDDMLARRHRNERAGMEQPLTPGNYTVDEIKALLRANLRRAPKNRRTKDTTVSEYHCVFSDCGKTMHADENAAVNIGGKFIADIEK

SEQ ID NO: 99 - protein, 1252 aa, Oleiphilus sp.
MTKLRHRQKKLTHDWAGSKKREVLGSNGKLQNPLLMPVKKGQVTEFRKAFSAYARATKGEMTDGRKNMFTHSFEPFKTKPSLHQCELADKAYQSLHSYLPGSLAHFLLSAHALGFRIFSKSGEATAFQASSKIEAYESKLASELACVDLSIQNLTISTLFNALTTSVRGKGEETSADPLIARFYTLLTGKPLSRDTQGPERDLAEVISRKIASSFGTWKEMTANPLQSLQFFEEELHALDANVSLSPAFDVLIKMNDLQGDLKNRTIVFDPDAPVFEYNAEDPADIIIKLTARYAKEAVIKNQNVGNYVKNAITTTNANGLGWLLNKGLSLLPVSTDDELLEFIGVERSHPSCHALIELIAQLEAPELFEKNVFSDTRSEVQGMIDSAVSNHIARLSSSRNSLSMDSEELERLIKSFQIHTPHCSLFIGAQSLSQQLESLPEALQSGVNSADILLGSTQYMLTNSLVEESIATYQRTLNRINYLSGVAGQINGAIKRKAIDGEKIHLPAAWSELISLPFIGQPVIDVESDLAHLKNQYQTLSNEFDTLISALQKNFDLNFNKALLNRTQHFEAMCRSTKKNALSKPEIVSYRDLLARLTSCLYRGSLVLRRAGIEVLKKHKIFESNSELREHVHERKHFVFVSPLDRKAKKLLRLTDSRPDLLHVIDEILQHDNLENKDRESLWLVRSGYLLAGLPDQLSSSFINLPIITQKGDRRLIDLIQYDQINRDAFVMLVTSAFKSNLSGLQYRANKQSFVVTRTLSPYLGSKLVYVPKDKDWLVPSQMFEGRFADILQSDYMVWKDAGRLCVIDTAKHLSNIKKSVFSSEEVLAFLRELPHRTFIQTEVRGLGVNVDGIAFNNGDIPSLKTFSNCVQVKVSRTNTSLVQTLNRWFEGGKVSPPSIQFERAYYKKDDQIHEDAAKRKIRFQMPATELVHASDDAGWTPSYLLGIDPGEYGMGLSLVSINNGEVLDSGFIHINSLINFASKKSNHQTKVVPRQQYKSPYANYLEQSKDSAAGDIAHILDRLIYKLNALPVFEALSGNSQSAADQVWTKVLSFYTWGDNDAQNSIRKQHWFGASHWDIKGMLRQPPTEKKPKPYIAFPGSQVSSYGNSQRCSCCGRNPIEQLREMAKDTSIKELKIRNSEIQLFDGTIKLFNPDPSTVIERRRHNLGPSRIPVADRTFKNISPSSLEFKELITIVSRSIRHSPEFIAKKRGIGSEYFCAYSDCNSSLNSEANAAANVAQKFQKQLFFEL

SEQ ID NO: 100 - protein, 767 aa, Artificial Sequence
  Description of Artificial Sequence: Synthetic polypeptide
MAQASSTPAVSPRPRPRYREERTLVRKLLPRPGQSKQEFRENVKKLRKAFLQFNADVSGVCQWAIQFRPRYGKPAEPTETFWKFFLEPETSLPPNDSRSPEFRRLQAFEAAAGINGAAALDDPAFTNELRDSILAVASRPKTKEAQRLFSRLKDYQPAHRMILAKVAAEWIESRYRRAHQNWERNYEEWKKEKQEWEQNHPELTPEIREAFNQIFQQLEVKEKRVRICPAARLLQNKDNCQYAGKNKHSVLCNQFNEFKKNHLQGKAIKFFYKDAEKYLRCGLQSLKPNVQGPFREDWNKYLRYMNLKEETLRGKNGGRLPHCKNLGQECEFNPHTALCKQYQQQLSSRPDLVQHDELYRKWRREYWREPRKPVFRYPSVKRHSIAKIFGENYFQADFKNSVVGLRLDSMPAGQYLEFAFAPWPRNYRPQPGETEISSVHLHFVGTRPRIGFRFRVPHKRSRFDCTQEELDELRSRTFPRKAQDQKFLEAARKRLLETFPGNAEQELRLLAVDLGTDSARAAFFIGKTFQQAFPLKIVKIEKLYEQWPNQKQAGDRRDASSKQPRPGLSRDHVGRHLQKMRAQASEIAQKRQELTGTPAPETTTDQAAKKATLQPFDLRGLTVHTARMIRDWARLNARQIIQLAEENQVDLIVLESLRGFRPPGYENLDQEKKRRVAFFAHGRIRRKVTEKAVERGMRVVTVPYLASSKVCAECRKKQKDNKQWEKNKKRGLFKCEGCGSQAQVDENAARVLGRVFWGEIELPTAIP

SEQ ID NO: 101 - protein, 870 aa, Artificial Sequence
  Description of Artificial Sequence: Synthetic polypeptide
MKVHEIPRSQLLKIKQYEGSFVEWYRDLQEDRKKFASLLFRWAAFGYAAREDDGATYISPSQALLERRLLLGDAEDVAIKFLDVLFKGGAPSSSCYSLFYEDFALRDKAKYSGAKREFIEGLATMPLDKIIERIRQDEQLSKIPAEEWLILGAEYSPEEIWEQVAPRIVNVDRSLGKQLRERLGIKCRRPHDAGYCKILMEVVARQLRSHNETYHEYLNQTHEMKTKVANNLTNEFDLVCEFAEVLEEKNYGLGWYVLWQGVKQALKEQKKPTKIQIAVDQLRQPKFAGLLTAKWRALKGAYDTWKLKKRLEKRKAFPYMPNWDNDYQIPVGLTGLGVFTLEVKRTEVVVDLKEHGKLFCSHSHYFGDLTAEKHPSRYHLKFRHKLKLRKRDSRVEPTIGPWIEAALREITIQKKPNGVFYLGLPYALSHGIDNFQIAKRFFSAAKPDKEVINGLPSEMVVGAADLNLSNIVAPVKARIGKGLEGPLHALDYGYGELIDGPKILTPDGPRCGELISLKRDIVEIKSAIKEFKACQREGLTMSEETTTWLSEVESPSDSPRCMIQSRIADTSRRLNSFKYQMNKEGYQDLAEALRLLDAMDSYNSLLESYQRMHLSPGEQSPKEAKFDTKRASFRDLLRRRVAHTIVEYFDDCDIVFFEDLDGPSDSDSRNNALVKLLSPRTLLLYIRQALEKRGIGMVEVAKDGTSQNNPISGHVGWRNKQNKSEIYFYEDKELLVMDADEVGAMNILCRGLNHSVCPYSFVTKAPEKKNDEKKEGDYGKRVKRFLKDRYGSSNVRFLVASMGFVTVTTKRPKDALVGKRLYYHGGELVTHDLHNRMKDEIKYLVEKEVLARRVSLSDSTIKSYKSFAHV

SEQ ID NO: 102 - protein, 1093 aa, Artificial Sequence
  Description of Artificial Sequence: Synthetic polypeptide
MSNKEKNASETRKAYTTKMIPRSHDRMKLLGNFMDYLMDGTPIFFELWNQFGGGIDRDIISGTANKDKISDDLLLAVNWFKVMPINSKPQGVSPSNLANLFQQYSGSEPDIQAQEYFASNFDTEKHQWKDMRVEYERLLAELQLSRSDMHHDLKLMYKEKCIGLSLSTAHYITSVMFGTGAKNNRQTKHQFYSKVIQLLEESTQINSVEQLASIILKAGDCDSYRKLRIRCSRKGATPSILKIVQDYELGTNHDDEVNVPSLIANLKEKLGRFEYECEWKCMEKIKAFLASKVGPYYLGSYSAMLENALSPIKGMTTKNCKFVLKQIDAKNDIKYENEPFGKIVEGFFDSPYFESDTNVKWVLHPHHIGESNIKTLWEDLNAIHSKYEEDIASLSEDKKEKRIKVYQGDVCQTINTYCEEVGKEAKTPLVQLLRYLYSRKDDIAVDKIIDGITFLSKKHKVEKQKINPVIQKYPSFNFGNNSKLLGKIISPKDKLKHNLKCNRNQVDNYIWIEIKVLNTKTMRWEKHHYALSSTRFLEEVYYPATSENPPDALAARFRTKTNGYEGKPALSAEQIEQIRSAPVGLRKVKKRQMRLEAARQQNLLPRYTWGKDFNINICKRGNNFEVTLATKVKKKKEKNYKVVLGYDANIVRKNTYAAIEAHANGDGVIDYNDLPVKPIESGFVTVESQVRDKSYDQLSYNGVKLLYCKPHVESRRSFLEKYRNGTMKDNRGNNIQIDFMKDFEAIADDETSLYYFNMKYCKLLQSSIRNHSSQAKEYREEIFELLRDGKLSVLKLSSLSNLSFVMFKVAKSLIGTYFGHLLKKPKNSKSDVKAPPITDEDKQKADPEMFALRLALEEKRLNKVKSKKEVIANKIVAKALELRDKYGPVLIKGENISDTTKKGKKSSTNSFLMDWLARGVANKVKEMVMMHQGLEFVEVNPNFTSHQDPFVHKNPENTFRARYSRCTPSELTEKNRKEILSFLSDKPSKRPTNAYYNEGAMAFLATYGLKKNDVLGVSLEKFKQIMANILHQRSEDQLLFPSRGGMFYLATYKLDADATSVNWNGKQFWVCNADLVAAYNVGLVDIQKDFKKK

SEQ ID NO: 103 - protein, 1054 aa, Artificial Sequence
  Description of Artificial Sequence: Synthetic polypeptide
MSSAIKSYKSVLRPNERKNQLLKSTIQCLEDGSAFFFKMLQGLFGGITPEIVRFSTEQEKQQQDIALWCAVNWFRPVSQDSLTHTIASDNLVEKFEEYYGGTASDAIKQYFSASIGESYYWNDCRQQYYDLCRELGVEVSDLTHDLEILCREKCLAVATESNQNNSIISVLFGTGEKEDRSVKLRITKKILEAISNLKEIPKNVAPIQEIILNVAKATKETFRQVYAGNLGAPSTLEKFIAKDGQKEFDLKKLQTDLKKVIRGKSKERDWCCQEELRSYVEQNTIQYDLWAWGEMFNKAHTALKIKSTRNYNFAKQRLEQFKEIQSLNNLLVVKKLNDFFDSEFFSGEETYTICVHHLGGKDLSKLYKAWEDDPADPENAIVVLCDDLKNNFKKEPIRNILRYIFTIRQECSAQDILAAAKYNQQLDRYKSQKANPSVLGNQGFTWTNAVILPEKAQRNDRPNSLDLRIWLYLKLRHPDGRWKKHHIPFYDTRFFQEIYAAGNSPVDTCQFRTPRFGYHLPKLTDQTAIRVNKKHVKAAKTEARIRLAIQQGTLPVSNLKITEISATINSKGQVRIPVKFDVGRQKGTLQIGDRFCGYDQNQTASHAYSLWEVVKEGQYHKELGCFVRFISSGDIVSITENRGNQFDQLSYEGLAYPQYADWRKKASKFVSLWQITKKNKKKEIVTVEAKEKFDAICKYQPRLYKFNKEYAYLLRDIVRGKSLVELQQIRQEIFRFIEQDCGVTRLGSLSLSTLETVKAVKGIIYSYFSTALNASKNNPISDEQRKEFDPELFALLEKLELIRTRKKKQKVERIANSLIQTCLENNIKFIRGEGDLSTTNNATKKKANSRSMDWLARGVFNKIRQLAPMHNITLFGCGSLYTSHQDPLVHRNPDKAMKCRWAAIPVKDIGDWVLRKLSQNLRAKNIGTGEYYHQGVKEFLSHYELQDLEEELLKWRSDRKSNIPCWVLQNRLAEKLGNKEAVVYIPVRGGRIYFATHKVATGAVSIVFDQKQVWVCNADHVAAANIALTVKGIGEQSSDEENPDGSRIKLQLTS

SEQ ID NO: 104 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatcccggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 105 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 106 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaaggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 107 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 108 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 109 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 110 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 111 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 112 - DNA, 4092 bp, Artificial Sequence
  Description of Artificial Sequence: Synthetic polynucleotide
gccaccatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagggaggctctggaggaagctccgaagtcgagttttcccatgagtactggatgagacacgcattgactctcgcaaagagggctcgagatgaacgcgaggtgcccgtgggggcagtactcgtgctcaacaatcgcgtaatcggcgaaggttggaatagggcaatcggactccacgaccccactgcacatgcggaaatcatggcccttcgacagggagggcttgtgatgcagaattatcgactttatgatgcgacgctgtacgtcacgtttgaaccttgcgtaatgtgcgcgggagctatgattcactcccgcattggacgagttgtattcggtgttcgcaacgccaagacgggtgccgcaggttcactgatggacgtgctgcatcatccaggcatgaaccaccgggtagaaatcacagaaggcatattggcggacgaatgtgcggcgctgttgtgtcgtttttttcgcatgcccaggcgggtctttaacgcccagaaaaaagcacaatcctctactgacggctcttctggatctgaaacacctggcacaagcgagagcgccacccctgagagctctggcctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaa

SEQ ID NO: 113 - protein, 1361 aa, Artificial Sequence
  Description of Artificial Sequence: Synthetic polypeptide
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKGGSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDGSSGSETPGTSESATPESSGLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKKGSYPYDVPDYAYPYDVPDYAYPYDVPDYA

SEQ ID NO: 114 - protein, 7 aa, Artificial Sequence
  Description of Artificial Sequence: Synthetic peptide
GGGSGGS

SEQ ID NO: 115 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESVLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 116 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 117 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 118 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 119 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 120 - protein, 29 aa, Artificial Sequence
  Description of Artificial Sequence: Synthetic peptide
PKKKRKVEGADKRTADGSEFESPKKKRKV

SEQ ID NO: 121 - protein, 23 aa, Artificial Sequence
  Description of Artificial Sequence: Synthetic peptide
RKSGKIAAIVVKRPRKPKKKRKV

SEQ ID NO: 122 - protein, 16 aa, Artificial Sequence
  Description of Artificial Sequence: Synthetic peptide
KRPAATKKAGQAKKKK

SEQ ID NO: 123 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 124 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 125 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 126 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 127 - protein, 198 aa, Homo sapiens [sequence omitted]

SEQ ID NO: 128 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 129 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 130 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 131 - protein, 239 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 132 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 133 - protein, 430 aa, Rattus norvegicus
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 134 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 135 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 136 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 137 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 138 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 139 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 140 - protein, 395 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 141 - protein, 226 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 142 - protein, 490 aa, Pan troglodytes
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 143 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 144 - protein, 190 aa, Gorilla gorilla
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 145 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 146 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 147 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 148 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 149 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 150 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 151 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 152 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 153 - protein, 229 aa, Rattus norvegicus [sequence omitted]

SEQ ID NO: 154 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 155 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 156 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 157 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 158 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 159 - protein, 381 aa, Artificial Sequence
  Description of Artificial Sequence: Synthetic polypeptide
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 160 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 161 - protein, 184 aa, Artificial Sequence
  Description of Artificial Sequence: Synthetic polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 162 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 163 - protein, 8 aa, Artificial Sequence
  Description of Artificial Sequence: Synthetic peptide
SGGSSGGS

SEQ ID NO: 164 - protein, 1609 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 165 - protein, 1807 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDGGSSGGSSGSETPGTSESATPESSGGSSGGSMSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 166 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 167 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 168 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 169 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 170 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 171 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 172 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 173 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 174 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 175 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 176 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 177 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 178 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 179 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 180 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 181 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 182 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHYPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 183 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRRVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 184 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 185 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 186 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 187 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 188 - protein, 4 aa, Artificial Sequence
  Description of Artificial Sequence: Synthetic peptide
SGGS

SEQ ID NO: 189 - protein, 4 aa, Artificial Sequence
  Description of Artificial Sequence: Synthetic peptide
GGGS

SEQ ID NO: 190 - protein, 5 aa, Artificial Sequence
  Description of Artificial Sequence: Synthetic peptide
GGGGS

SEQ ID NO: 191 - protein, 5 aa, Artificial Sequence
  Description of Artificial Sequence: Synthetic peptide
EAAAK

SEQ ID NO: 192 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 193 - protein, 5 aa, Artificial Sequence
  Description of Artificial Sequence: Synthetic peptide
PAPAP

SEQ ID NO: 194 - protein, 6 aa, Artificial Sequence
  Description of Artificial Sequence: Synthetic peptide
PAPAPA

SEQ ID NO: 195 - protein, 7 aa, Artificial Sequence
  Description of Artificial Sequence: Synthetic peptide
PAPAPAP

SEQ ID NO: 196 - protein, 8 aa, Artificial Sequence
  Description of Artificial Sequence: Synthetic peptide
PAPAPAPA

SEQ ID NO: 197 - protein, 9 aa, Artificial Sequence
  Description of Artificial Sequence: Synthetic peptide
PAPAPAPAP

SEQ ID NO: 198 - protein, 15 aa, Artificial Sequence
  Description of Artificial Sequence: Synthetic peptide
PAPAPAPAPAPAPAP

SEQ ID NO: 199 - protein, 21 aa, Artificial Sequence
  Description of Artificial Sequence: Synthetic peptide
PAPAPAPAPAPAPAPAPAPAP

SEQ ID NO: 200 - DNA, 117 bp, Artificial Sequence
  Description of Artificial Sequence: Synthetic oligonucleotide
  Description of Combined DNA/RNA Molecule: Synthetic oligonucleotide
  modified_base (98)..(117): a, c, t, g, unknown or other
guucugtcuuuuggucaggacaaccgucuagcuauaagugcugcagggugugagaaacuccuauugcuggacgaugucucuuacgaggcauuagcacnnnnnnnnnnnnnnnnnnnn

SEQ ID NO: 201 - RNA, 108 nt, Artificial Sequence
  Description of Artificial Sequence: Synthetic polynucleotide
  modified_base (89)..(108): a, c, u, g, unknown or other
gaccuauagggucaaugaaucugugcgugugccauaaguaauuaaaaauuacccaccacaggagcaccugaaaacaggugcuuggcacnnnnnnnnnnnnnnnnnnnn

SEQ ID NO: 202 - RNA, 119 nt, Artificial Sequence
  Description of Artificial Sequence: Synthetic polynucleotide
  modified_base (100)..(119): a, c, u, g, unknown or other
gucuaaaggacagaauuuuucaacgggugugccaauggccacuuuccagguggcaaagcccguugaacuucucaaaaagaacgaucugagaaguggcacnnnnnnnnnnnnnnnnnnnn

SEQ ID NO: 203 - protein, 6 aa, Artificial Sequence
  Description of Artificial Sequence: Synthetic peptide
GGSGGS

SEQ ID NO: 204 - protein, 20 aa, Artificial Sequence
  Description of Artificial Sequence: Synthetic peptide
GSSGSETPGTSESATPESSG

SEQ ID NO: 205 - DNA, 18 bp, Artificial Sequence
  Description of Artificial Sequence: Synthetic oligonucleotide
ggaggctctggaggaagc

SEQ ID NO: 206 - DNA, 60 bp, Artificial Sequence
  Description of Artificial Sequence: Synthetic oligonucleotide
ggctcttctggatctgaaacacctggcacaagcgagagcgccacccctgagagctctggc

SEQ ID NO: 207 - protein, 17 aa, Artificial Sequence
  Description of Artificial Sequence: Synthetic peptide
MAPKKKRKVGIHGVPAA

SEQ ID NO: 208 - DNA, 51 bp, Artificial Sequence
  Description of Artificial Sequence: Synthetic oligonucleotide
atggccccaaagaagaagcggaaggtcggtatccacggagtcccagcagcc

SEQ ID NO: 209 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 210 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 211 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 212 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 213 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDTGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 214 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 215 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 216 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 217 - protein, 1540 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 218 - protein, 1540 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 219 - protein, 1543 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 220 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 221 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRREDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 222 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 223 - protein, 1551 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSSGSETPGTSESATPESGSSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 224 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 225 - protein, 1546 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDGSSGSSGSETPGTSESATPESGSSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 226 - protein, 1533 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPGSSGSETPGTSESATPESSGSEVEFSHEYWMRHALTLAKRARDEREVPVGAVLVLNNRVIGEGWNRAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 227 - protein, 1549 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 228 - protein, 1555 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSSGSETPGTSESATPESSGGSSIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 229 - protein, 1421 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 230 - protein, 1552 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 231 - protein, 1545 aa, Artificial Sequence
  Description of Artificial Sequence: Synthetic polypeptide
MSEVEFSHEYWMRHALTLAKRARDEREVPVGAVLVLNNRVIGEGWNRTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 232 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 233 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 234 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 235 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 236 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 237 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 238 - protein, 1541 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKEGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQLGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 239 - protein, 1484 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYSSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 240 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 241 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 242 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 243 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLAMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 244 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 245 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGDKPIREQAENIIHLFTLTNLGAPAAFKYFDTTIDRKRYTSTKEVLDATLIHQSITGLYETRIDLSQLGGD

SEQ ID NO: 246 - protein, 1454 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 247 - protein, 1420 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 248 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 249 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 250 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 251 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEITAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 252 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 253 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 254 - protein, 1554 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGSSGSETPGTSESATPESSGSEVEFSHEYWMRHALTLAKRARDEREVPVGAVLVLNNRVIGEGWNRAIGLHDPSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 255 - DNA, 933 bp, Unknown
  Description of Unknown: Inactivated kanamycin resistance gene sequence
ccggaattgccagctggggcgccctctggtaaggttgggaagccctgcaaagtaaactggatggctttcttgccgccaaggatctgatggcgcaggggatcaagatctgatcaagagacaggatgaggatcctttcgcatgatcgaataagatggattgcacgcaggttctccggccgcttaggtggagcgcctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcattaactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaa

SEQ ID NO: 256 - RNA, 20 nt, Artificial Sequence
  Description of Artificial Sequence: Synthetic oligonucleotide
gaacacaaagcauagacugc

SEQ ID NO: 257 - RNA, 20 nt, Artificial Sequence
  Description of Artificial Sequence: Synthetic oligonucleotide
gggaaagacccagcauccgu

SEQ ID NO: 258 - RNA, 20 nt, Artificial Sequence
  Description of Artificial Sequence: Synthetic oligonucleotide
gcucccaucacaucaaccgg

SEQ ID NO: 259 - RNA, 20 nt, Artificial Sequence
  Description of Artificial Sequence: Synthetic oligonucleotide
ggugagugagugugugcgug

SEQ ID NO: 260 - RNA, 20 nt, Artificial Sequence
  Description of Artificial Sequence: Synthetic oligonucleotide
ggcuucagguucuaaaugag

SEQ ID NO: 261 - RNA, 20 nt, Artificial Sequence
  Description of Artificial Sequence: Synthetic oligonucleotide
gcagagagucgccgucucca

SEQ ID NO: 262 - RNA, 20 nt, Artificial Sequence
  Description of Artificial Sequence: Synthetic oligonucleotide
guguaagaccucaaaagcac

SEQ ID NO: 263 - RNA, 20 nt, Artificial Sequence
  Description of Artificial Sequence: Synthetic oligonucleotide
gaugagaaggagaaguucuu

SEQ ID NO: 264 - RNA, 20 nt, Artificial Sequence
  Description of Artificial Sequence: Synthetic oligonucleotide
gaggacaaaguacaaacggc

SEQ ID NO: 265 - RNA, 20 nt, Artificial Sequence
  Description of Artificial Sequence: Synthetic oligonucleotide
gccaccacagggaagcuggg

SEQ ID NO: 266 - RNA, 20 nt, Artificial Sequence
  Description of Artificial Sequence: Synthetic oligonucleotide
gcucucaggcccuguccgca

SEQ ID NO: 267 - RNA, 20 nt, Artificial Sequence
  Description of Artificial Sequence: Synthetic oligonucleotide
gagcaaauaccagagauaag

SEQ ID NO: 268 - RNA, 20 nt, Artificial Sequence
  Description of Artificial Sequence: Synthetic oligonucleotide
gaucaggaaauagagccaca

SEQ ID NO: 269 - RNA, 20 nt, Artificial Sequence
  Description of Artificial Sequence: Synthetic oligonucleotide
gcccaucccugaguccagcg

SEQ ID NO: 270 - RNA, 23 nt, Artificial Sequence
  Description of Artificial Sequence: Synthetic oligonucleotide
gaacacgaagacaucugaaggua

SEQ ID NO: 271 - RNA, 23 nt, Artificial Sequence
  Description of Artificial Sequence: Synthetic oligonucleotide
gauuuacagccuggccuuugggg

SEQ ID NO: 272 - RNA, 22 nt, Artificial Sequence
  Description of Artificial Sequence: Synthetic oligonucleotide
ggagagaaagagaaguugauug

SEQ ID NO: 273 - RNA, 22 nt, Artificial Sequence
  Description of Artificial Sequence: Synthetic oligonucleotide
gagggugagggaugagauaaug

SEQ ID NO: 274 - RNA, 22 nt, Artificial Sequence
  Description of Artificial Sequence: Synthetic oligonucleotide
gguggaggagggugcauggggu

SEQ ID NO: 275 - RNA, 22 nt, Artificial Sequence
  Description of Artificial Sequence: Synthetic oligonucleotide
gcuguugcaugaggaaagggac

SEQ ID NO: 276 - RNA, 20 nt, Artificial Sequence
  Description of Artificial Sequence: Synthetic oligonucleotide
ggcccagacugagcacguga

SEQ ID NO: 277 - RNA, 20 nt, Artificial Sequence
  Description of Artificial Sequence: Synthetic oligonucleotide
ggcacugcggcuggaggugg

SEQ ID NO: 278 - RNA, 21 nt, Artificial Sequence
  Description of Artificial Sequence: Synthetic oligonucleotide
gcagagcacuggaauucguca

SEQ ID NO: 279 - RNA, 76 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugc

SEQ ID NO: 280 - RNA, 84 nt, Artificial Sequence
  Description of Artificial Sequence: Synthetic oligonucleotide
guuuuaguacucuguaaugaaaauuacagaaucuacuaaaacaaggcaaaaugccguguuuaucucgucaacuuguuggcgaga

SEQ ID NO: 281 - DNA, 20 bp, Artificial Sequence
  Description of Artificial Sequence: Synthetic oligonucleotide
cttaccccacttaactatct

SEQ ID NO: 282 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnccagccccatctgtcaaact

SEQ ID NO: 283 - DNA, 54 bp, Artificial Sequence
  Description of Artificial Sequence: Synthetic primer
tggagttcagacgtgtgctcttccgatcttgaatggattccttggaaacaatga

SEQ ID NO: 284 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgagggagagccgtgtagtt

SEQ ID NO: 285 - DNA, 49 bp, Artificial Sequence
  Description of Artificial Sequence: Synthetic primer
tggagttcagacgtgtgctcttccgatctgcctctcaaagtgctgggat

SEQ ID NO: 286 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnccatcaggctctcagctcag

SEQ ID NO: 287 - DNA, 48 bp, Artificial Sequence
  Description of Artificial Sequence: Synthetic primer
tggagttcagacgtgtgctcttccgatctctcgtgggtttgtggttgc

SEQ ID NO: 288 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngcccattccctctttagcca

SEQ ID NO: 289 - DNA, 49 bp, Artificial Sequence
  Description of Artificial Sequence: Synthetic primer
tggagttcagacgtgtgctcttccgatctgagccgttccctctttgcta

SEQ ID NO: 290 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnaacctgtgtgacacttggca

SEQ ID NO: 291 - DNA, 49 bp, Artificial Sequence
  Description of Artificial Sequence: Synthetic primer
tggagttcagacgtgtgctcttccgatctgtctggcccaagatcacaca

SEQ ID NO: 292 - DNA, 56 bp, Artificial Sequence
  Description of Artificial Sequence: Synthetic primer
  modified_base (34)..(36): a, c, t, g, unknown or other
acactctttccctacacgacgctcttccgatctnnncacggataaagacgctggga

SEQ ID NO: 293 - DNA, 47 bp, Artificial Sequence
  Description of Artificial Sequence: Synthetic primer
tggagttcagacgtgtgctcttccgatctggggtcccaggtgctgac

SEQ ID NO: 294 - DNA, 56 bp, Artificial Sequence
  Description of Artificial Sequence: Synthetic primer
  modified_base (34)..(36): a, c, t, g, unknown or other
acactctttccctacacgacgctcttccgatctnnnttgattgtctcctttgccgc

SEQ ID NO: 295 - DNA, 53 bp, Artificial Sequence
  Description of Artificial Sequence: Synthetic primer
tggagttcagacgtgtgctcttccgatcttgacccagtgtttgatagatcagt

SEQ ID NO: 296 - DNA, 56 bp, Artificial Sequence
  Description of Artificial Sequence: Synthetic primer
  modified_base (34)..(36): a, c, t, g, unknown or other
acactctttccctacacgacgctcttccgatctnnncaccccttcagtccatgctt

SEQ ID NO: 297 - DNA, 49 bp, Artificial Sequence
  Description of Artificial Sequence: Synthetic primer
tggagttcagacgtgtgctcttccgatcttctgatggggaggaacgagt

SEQ ID NO: 298 - DNA, 57 bp, Artificial Sequence
  Description of Artificial Sequence: Synthetic primer
  modified_base (34)..(37): a, c, t, g, unknown or other
acactctttccctacacgacgctcttccgatctnnnncagctcagcctgagtgttga

SEQ ID NO: 299 - DNA, 49 bp, Artificial Sequence
  Description of Artificial Sequence: Synthetic primer
tggagttcagacgtgtgctcttccgatctgcccaccctagtcattggag

SEQ ID NO: 300 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngtcagagggacacactgtgg

SEQ ID NO: 301 - DNA, 49 bp, Artificial Sequence
  Description of Artificial Sequence: Synthetic primer
tggagttcagacgtgtgctcttccgatctcacactcactcacccacaca

SEQ ID NO: 302 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgtgtgggtgagtgagtgtg

SEQ ID NO: 303 - DNA, 49 bp, Artificial Sequence
  Description of Artificial Sequence: Synthetic primer
tggagttcagacgtgtgctcttccgatctcaccaaggttcacagcctga

SEQ ID NO: 304 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnttgtctctgcctgtagctgc

SEQ ID NO: 305 - DNA, 49 bp, Artificial Sequence
  Description of Artificial Sequence: Synthetic primer
tggagttcagacgtgtgctcttccgatctcgctctgggcttcatcttca

SEQ ID NO: 306 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgggattatgggtgtgagcc

SEQ ID NO: 307 - DNA, 49 bp, Artificial Sequence
  Description of Artificial Sequence: Synthetic primer
tggagttcagacgtgtgctcttccgatcttgccttcctcctctctctcc

SEQ ID NO: 308 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgcagaccagattcggagaa

SEQ ID NO: 309 - DNA, 49 bp, Artificial Sequence
  Description of Artificial Sequence: Synthetic primer
tggagttcagacgtgtgctcttccgatctgttcagtttccagggggtcc

SEQ ID NO: 310 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntccgcacagccttagttcaa

SEQ ID NO: 311 - DNA, 49 bp, Artificial Sequence
  Description of Artificial Sequence: Synthetic primer
tggagttcagacgtgtgctcttccgatctaacttgaagagacggcagca

SEQ ID NO: 312 - DNA, 57 bp, Artificial Sequence
  Description of Artificial Sequence: Synthetic primer
  modified_base (34)..(37): a, c, t, g, unknown or other
acactctttccctacacgacgctcttccgatctnnnncccccagctacagaaaggtc

SEQ ID NO: 313 - DNA, 49 bp, Artificial Sequence
  Description of Artificial Sequence: Synthetic primer
tggagttcagacgtgtgctcttccgatctatttccaccgcaaaatggcc

SEQ ID NO: 314 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntcacttcagcccaggagtat

SEQ ID NO: 315 - DNA, 51 bp, Artificial Sequence
  Description of Artificial Sequence: Synthetic primer
tggagttcagacgtgtgctcttccgatcttgtgtatggtgagaggtaggga

SEQ ID NO: 316 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngtctgaggtcacacagtggg

SEQ ID NO: 317 - DNA, 49 bp, Artificial Sequence
  Description of Artificial Sequence: Synthetic primer
tggagttcagacgtgtgctcttccgatctctgagagcagggaccacatc

SEQ ID NO: 318 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngggaggtggagagaggatgt

SEQ ID NO: 319 - DNA, 54 bp, Artificial Sequence
  Description of Artificial Sequence: Synthetic primer
tggagttcagacgtgtgctcttccgatctactcttcctgaggtctaggaacccg

SEQ ID NO: 320 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnccctgttcctaaagcccacc

SEQ ID NO: 321 - DNA, 53 bp, Artificial Sequence
  Description of Artificial Sequence: Synthetic primer
tggagttcagacgtgtgctcttccgatctactctctggttctgtttgtggcca

SEQ ID NO: 322 - DNA, 60 bp, Artificial Sequence
  Description of Artificial Sequence: Synthetic primer
  modified_base (34)..(37): a, c, t, g, unknown or other
acactctttccctacacgacgctcttccgatctnnnnatttgatggagttggacatggcc

SEQ ID NO: 323 - DNA, 46 bp, Artificial Sequence
  Description of Artificial Sequence: Synthetic primer
tggagttcagacgtgtgctctccagctacttgttcttgagtgaagg

SEQ ID NO: 324 - DNA, 59 bp, Artificial Sequence
  Description of Artificial Sequence: Synthetic primer
  modified_base (34)..(37): a, c, t, g, unknown or other
acactctttccctacacgacgctcttccgatctnnnntggctttccaaatcagtgggtc

SEQ ID NO: 325 - DNA, 52 bp, Artificial Sequence
  Description of Artificial Sequence: Synthetic primer
tggagttcagacgtgtgctcttccgatctctcataagcttagaccaacaagc

SEQ ID NO: 326 - DNA, 58 bp, Artificial Sequence
  Description of Artificial Sequence: Synthetic primer
  modified_base (34)..(37): a, c, t, g, unknown or other
acactctttccctacacgacgctcttccgatctnnnnctggttgaccaatctgtggtg

SEQ ID NO: 327 - DNA, 41 bp, Artificial Sequence
  Description of Artificial Sequence: Synthetic primer
tggagttcagacgtgtgctctctgcgtctggatcaggtacg

SEQ ID NO: 328 - DNA, 58 bp, Artificial Sequence
  Description of Artificial Sequence: Synthetic primer
  modified_base (34)..(37): a, c, t, g, unknown or other
acactctttccctacacgacgctcttccgatctnnnngtgtggagagtgagtaagcca

SEQ ID NO: 329 - DNA, 50 bp, Artificial Sequence
  Description of Artificial Sequence: Synthetic primer
tggagttcagacgtgtgctcttccgatctacggtaggatgatttcaggca

SEQ ID NO: 330 - DNA, 58 bp, Artificial Sequence
  Description of Artificial Sequence: Synthetic primer
  modified_base (34)..(37): a, c, t, g, unknown or other
acactctttccctacacgacgctcttccgatctnnnncacaaagcagtgtagctcagg

SEQ ID NO: 331 - DNA, 54 bp, Artificial Sequence
  Description of Artificial Sequence: Synthetic primer
tggagttcagacgtgtgctcttccgatcttttttggtactcgagtgttattcag

SEQ ID NO: 332 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntcccctgttgacctggagaa

SEQ ID NO: 333 - DNA, 49 bp, Artificial Sequence
  Description of Artificial Sequence: Synthetic primer
tggagttcagacgtgtgctcttccgatctcactgtacttgccctgacca

SEQ ID NO: 334 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnttggtgttgacagggagcaa

SEQ ID NO: 335 - DNA, 49 bp, Artificial Sequence
  Description of Artificial Sequence: Synthetic primer
tggagttcagacgtgtgctcttccgatctctgagatgtgggcagaaggg

SEQ ID NO: 336 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgagagggaacagaagggct

SEQ ID NO: 337 - DNA, 49 bp, Artificial Sequence
  Description of Artificial Sequence: Synthetic primer
tggagttcagacgtgtgctcttccgatctgtccaaaggcccaagaacct

SEQ ID NO: 338 - DNA, 58 bp, Artificial Sequence
  Description of Artificial Sequence: Synthetic primer
  modified_base (34)..(37): a, c, t, g, unknown or other
acactctttccctacacgacgctcttccgatctnnnntcctagcactttggaaggtcg

SEQ ID NO: 339 - DNA, 51 bp, Artificial Sequence
  Description of Artificial Sequence: Synthetic primer
tggagttcagacgtgtgctcttccgatctgctcatcttaatctgctcagcc

SEQ ID NO: 340 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnaaaggagcagctcttcctgg

SEQ ID NO: 341 - DNA, 49 bp, Artificial Sequence
  Description of Artificial Sequence: Synthetic primer
tggagttcagacgtgtgctcttccgatctgtctgcaccatctcccacaa

SEQ ID NO: 342 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnggcatggcttctgagactca

SEQ ID NO: 343 - DNA, 53 bp, Artificial Sequence
  Description of Artificial Sequence: Synthetic primer
tggagttcagacgtgtgctcttccgatctgtctcccttgcactccctgtcttt

SEQ ID NO: 344 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntttggcaatggaggcattgg

SEQ ID NO: 345 - DNA, 49 bp, Artificial Sequence
  Description of Artificial Sequence: Synthetic primer
tggagttcagacgtgtgctcttccgatctgaagaggctgcccatgagag

SEQ ID NO: 346 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnggtctgaggctcgaatcctg

SEQ ID NO: 347 - DNA, 49 bp, Artificial Sequence
  Description of Artificial Sequence: Synthetic primer
tggagttcagacgtgtgctcttccgatctctgtggcctccatatccctg

SEQ ID NO: 348 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntttccaccagaactcagccc

SEQ ID NO: 349 - DNA, 49 bp, Artificial Sequence
  Description of Artificial Sequence: Synthetic primer
tggagttcagacgtgtgctcttccgatctcctcggttcctccacaacac

SEQ ID NO: 350 - DNA, 57 bp, Artificial Sequence
  Description of Artificial Sequence: Synthetic primer
  modified_base (34)..(37): a, c, t, g, unknown or other
acactctttccctacacgacgctcttccgatctnnnncacgggaaggacaggagaag

SEQ ID NO: 351 - DNA, 49 bp, Artificial Sequence
  Description of Artificial Sequence: Synthetic primer
tggagttcagacgtgtgctcttccgatctgcaggggagggataaagcag

SEQ ID NO: 352 - DNA, 59 bp, Artificial Sequence
  Description of Artificial Sequence: Synthetic primer
  modified_base (34)..(37): a, c, t, g, unknown or other
acactctttccctacacgacgctcttccgatctnnnnggaaacgcccatgcaattagtc

SEQ ID NO: 353 - DNA, 51 bp, Artificial Sequence
  Description of Artificial Sequence: Synthetic primer
tggagttcagacgtgtgctcttccgatctcttgtcaaccagtatcccggtg

SEQ ID NO: 354 - DNA, 61 bp, Artificial Sequence
  Description of Artificial Sequence: Synthetic primer
  modified_base (34)..(37): a, c, t, g, unknown or other
acactctttccctacacgacgctcttccgatctnnnntgaatggattccttggaaacaatg

SEQ ID NO: 355 - DNA, 49 bp, Artificial Sequence
  Description of Artificial Sequence: Synthetic primer
tggagttcagacgtgtgctcttccgatctccagccccatctgtcaaact

SEQ ID NO: 356 - DNA, 49 bp, Artificial Sequence
  Description of Artificial Sequence: Synthetic primer
tggagttcagacgtgtgctcttccgatcttcctttcaacccgaacggag

SEQ ID NO: 357 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngctggtcttctttcccctcc

SEQ ID NO: 358 - DNA, 59 bp, Artificial Sequence
  Description of Artificial Sequence: Synthetic primer
  modified_base (34)..(37): a, c, t, g, unknown or other
acactctttccctacacgacgctcttccgatctnnnngccctgcttctttttctctggt

SEQ ID NO: 359 - DNA, 51 bp, Artificial Sequence
  Description of Artificial Sequence: Synthetic primer
tggagttcagacgtgtgctcttccgatctaccattaacgcagccaacttca

SEQ ID NO: 360 - DNA, 60 bp, Artificial Sequence
  Description of Artificial Sequence: Synthetic primer
acactctttccctacacgacgctcttccgatctcatgaggtctatggacttcaagagcaa

SEQ ID NO: 361 - DNA, 56 bp, Artificial Sequence
  Description of Artificial Sequence: Synthetic primer
tggagttcagacgtgtgctcttccgatctcatcattgaccagagctctgggcagaa

SEQ ID NO: 362 - DNA, 60 bp, Artificial Sequence
  Description of Artificial Sequence: Synthetic primer
acactctttccctacacgacgctcttccgatctgcacttaccagcattacttcctaaacc

SEQ ID NO: 363 - DNA, 55 bp, Artificial Sequence
  Description of Artificial Sequence: Synthetic primer
tggagttcagacgtgtgctcttccgatctatgggctccacttttcagctctgtaa

SEQ ID NO: 364 - DNA, 57 bp, Artificial Sequence
  Description of Artificial Sequence: Synthetic primer
acactctttccctacacgacgctcttccgatctcagttcaggcacatgtaggaggga

SEQ ID NO: 365 - DNA, 56 bp, Artificial Sequence
  Description of Artificial Sequence: Synthetic primer
tggagttcagacgtgtgctcttccgatctaccgcctgcagctgtcggacactggca

SEQ ID NO: 366 - DNA, 56 bp, Artificial Sequence
  Description of Artificial Sequence: Synthetic primer
acactctttccctacacgacgctcttccgatctaaaagatgagtatgcctgccgtg

SEQ ID NO: 367 - DNA, 56 bp, Artificial Sequence
  Description of Artificial Sequence: Synthetic primer
tggagttcagacgtgtgctcttccgatctcagattgtttatatcagatgggatggg

SEQ ID NO: 368 - DNA, 59 bp, Artificial Sequence
  Description of Artificial Sequence: Synthetic primer
acactctttccctacacgacgctcttccgatctatgcaagtttggtcctgagccctccc

SEQ ID NO: 369 - DNA, 53 bp, Artificial Sequence
  Description of Artificial Sequence: Synthetic primer
tggagttcagacgtgtgctcttccgatctgatgtgggttccctgcgctctgca

SEQ ID NO: 370 - DNA, 57 bp, Artificial Sequence
  Description of Artificial Sequence: Synthetic primer
acactctttccctacacgacgctcttccgatctccagggactgagggtggaaggtcc

SEQ ID NO: 371 - DNA, 52 bp, Artificial Sequence
  Description of Artificial Sequence: Synthetic primer
tggagttcagacgtgtgctcttccgatctacctccgcctgagcagtggagaa

SEQ ID NO: 372 - RNA, 120 nt, Artificial Sequence
  Description of Artificial Sequence: Synthetic polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 373 - DNA, 27 bp, Artificial Sequence
  Description of Artificial Sequence: Synthetic primer
tcgagctcggtacctaatacgactcac

SEQ ID NO: 374 - DNA, 149 bp, Artificial Sequence
  Description of Artificial Sequence: Synthetic primer
ttttttttttttttttttttttttttttttttttttttttttttttttttttttttttttttttttttttttttttttttttttttttttttttttttttttttttttttttttttttttcttcctactcaggctttattcaaagacca

SEQ ID NO: 375 - RNA, 20 nt, Artificial Sequence
  Description of Artificial Sequence: Synthetic oligonucleotide
cuuaccccacuuaacuaucu

SEQ ID NO: 376 - RNA, 20 nt, Artificial Sequence
  Description of Artificial Sequence: Synthetic oligonucleotide
cccuaccugucaccaggacc

SEQ ID NO: 377 - RNA, 20 nt, Artificial Sequence
  Description of Artificial Sequence: Synthetic oligonucleotide
caccuaccuaagaaccaucc

SEQ ID NO: 378 - RNA, 20 nt, Artificial Sequence
  Description of Artificial Sequence: Synthetic oligonucleotide
cacucaccuuagccugagca

SEQ ID NO: 379 - RNA, 20 nt, Artificial Sequence
  Description of Artificial Sequence: Synthetic oligonucleotide
cuuaccugggcuggggaaga

SEQ ID NO: 380 - RNA, 20 nt, Artificial Sequence
  Description of Artificial Sequence: Synthetic oligonucleotide
auuauaccugccaugccgua

SEQ ID NO: 381 - RNA, 20 nt, Artificial Sequence
  Description of Artificial Sequence: Synthetic oligonucleotide
guggggaaggggcccccaag

SEQ ID NO: 382 - RNA, 80 nt, Artificial Sequence; identical to SEQ ID NO: 77
  Description of Artificial Sequence: Synthetic oligonucleotide

SEQ ID NO: 383 - DNA, 13 bp, Homo sapiens
ttgaccaatagcc

SEQ ID NO: 384 - DNA, 67 bp, Homo sapiens
tggctaaactccacccatgggttggccagccttgccttgaccaatagccttgacaaggcaaacttga

SEQ ID NO: 385 - protein, 8 aa, Artificial Sequence
  Description of Artificial Sequence: Synthetic peptide
  MOD_RES (5)..(5): Val or Ala
  MOD_RES (8)..(8): Ser or Pro
HLTPXEKX

SEQ ID NO: 386 - DNA, 25 bp, Artificial Sequence
  Description of Artificial Sequence: Synthetic oligonucleotide
gcatctgactcctgtggagaagtct

SEQ ID NO: 387 - DNA, 25 bp, Artificial Sequence
  Description of Artificial Sequence: Synthetic oligonucleotide
agacttctccacaggagtcagatgc

SEQ ID NO: 388 - protein, 8 aa, Artificial Sequence
  Description of Artificial Sequence: Synthetic peptide
HLTPVEKS

SEQ ID NO: 389 - DNA, 20 bp, Artificial Sequence
  Description of Artificial Sequence: Synthetic oligonucleotide
gaacacaaagcatagactgc

SEQ ID NO: 390 - DNA, 20 bp, Artificial Sequence
  Description of Artificial Sequence: Synthetic oligonucleotide
gggaaagacccagcatccgt

SEQ ID NO: 391 - DNA, 20 bp, Artificial Sequence
  Description of Artificial Sequence: Synthetic oligonucleotide
gctcccatcacatcaaccgg

SEQ ID NO: 392 - DNA, 20 bp, Artificial Sequence
  Description of Artificial Sequence: Synthetic oligonucleotide
ggcttcaggttctaaatgag

SEQ ID NO: 393 - DNA, 20 bp, Artificial Sequence
  Description of Artificial Sequence: Synthetic oligonucleotide
gcagagagtcgccgtctcca

SEQ ID NO: 394 - DNA, 20 bp, Artificial Sequence
  Description of Artificial Sequence: Synthetic oligonucleotide
gtgtaagacctcaaaagcac

SEQ ID NO: 395 - DNA, 23 bp, Homo sapiens
gtggggaaggggcccccaagagg

What is claimed is:

1. A fusion protein comprising a polynucleotide programmable DNA binding domain and at least one adenosine deaminase variant comprising a serine (S) at amino acid position 82 of the following sequence and having at least 85% identity to the following sequence

MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHS

-continued

RIGRVVFGVRNAKTGAAGSLMDVLHYPGMNHRVEITEGILADECAALLC

YFFRMPRQVFNAQKKAQSST (SEQ ID NO: 4).

2. The fusion protein of claim 1, wherein the adenosine deaminase variant further comprises an alteration at amino acid position 166.
3. The fusion protein of claim 1, wherein the adenosine deaminase variant further comprises a T166R alteration.
4. The fusion protein of claim 1, wherein the adenosine deaminase variant further comprises one or more of the following alterations: Y147T, Y147R, Q154S, Y123H, and Q154R.

5. The fusion protein of claim 1, wherein the adenosine deaminase variant further comprises an alteration or combination of alterations selected from the group consisting of:
   Y147T and Q154R;
   Y147T and Q154S;
   Y147R and Q154S;
   Q154S;
   Y147R;
   Q154R;
   Y123H;
   I76Y;
   Y123H, and Y147T;
   Y123H, and Y147R;
   Y123H, and Q154R;
   Y147R, Q154R, and Y123H;
   Y147R, Q154R, and I76Y;
   Y147R, Q154R, and T166R;
   Y123H, Y147R, Q154R, and I76Y;
   Y123H, Y147R, and Q154R; and
   I76Y, Y123H, Y147R, and Q154R.

6. The fusion protein of claim 1, wherein the fusion protein further comprises a second adenosine deaminase variant or a second adenosine deaminase.

7. The fusion protein of claim 1, wherein the fusion protein is ABE8.5-m, ABE8.14-m, ABE8.15-m, ABE8.16-m, ABE8.17-m, ABE8.18-m, ABE8.19-m, ABE8.20-m, ABE8.22-m, ABE8.23-m, or ABE8.24-m.

8. The fusion protein of claim 6, wherein the second adenosine deaminase comprises a wild-type adenosine deaminase.

9. The fusion protein of claim 8, wherein the fusion protein is ABE8.5-d, ABE8.14-d, ABE8.15-d, ABE8.16-d, ABE8.17-d, ABE8.18-d, ABE8.19-d, ABE8.20-d, ABE8.22-d, ABE8.23-d, or ABE8.24-d.

10. The fusion protein of claim 1, wherein the adenosine deaminase variant is TadA*8.14, TadA*8.15, TadA*8.16, TadA*8.17, TadA*8.18, TadA*8.19, TadA*8.20, TadA*8.22, TadA*8.23, or TadA*8.24.

11. The fusion protein of claim 1, wherein the adenosine deaminase variant comprises a deletion of 1, 2, 3, 4, 5, 6, 7, or 8 N-terminal or C-terminal amino acid residues relative to the full-length adenosine deaminase.

12. The fusion protein of claim 1, wherein the polynucleotide programmable DNA binding domain comprises the following sequence:

EIGKATAKYFFYSNIMNFFKTEITLANGEIRKRPLIETNGETGEIVWDK
GRDFATVRKVLSMPQVNIVKKTEVQTGGFSKESILPKRNSDKLIARKKD
WDPKKYGGFMQPTVAYSVLVVAKVEKGKSKKLKSVKELLGITIMERSSF
EKNPIDFLEAKGYKEVKKDLIIKLPKYSLFELENGRKRMLASAKFLQKG
NELALPSKYVNFLYLASHYEKLKGSPEDNEQKQLFVEQHKHYLDEIIEQ
ISEFSKRVILADANLDKVLSAYNKHRDKPIREQAENIIHLFTLTNLGAP
RAFKYFDTTIARKEYRSTKEVLDATLIHQSITGLYETRIDLSQLGGDGG
SGGSGGSGGSGGSGGSGGMDKKYSIGLAIGTNSVGWAVITDEYKVPSKK
FKVLGNTDRHSIKKNLIGALLFDSGETAEATRLKRTARRRYTRRKNRIC
YLQEIFSNEMAKVDDSFFHRLEESFLVEEDKKHERHPIFGNIVDEVAYH
EKYPTIYHLRKKLVDSTDKADLRLIYLALAHMIKFRGHFLIEGDLNPDN
SDVDKLFIQLVQTYNQLFEENPINASGVDAKAILSARLSKSRRLENLIA

QLPGEKKNGLFGNLIALSLGLTPNFKSNFDLAEDAKLQLSKDTYDDDLD
NLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYK
FIKPILEKMDGTEELLVKLNREDLLRKQRTFDNGSIPHQIHLGELHAIL
RRQEDFYPFLKDNREKIEKILTFRIPYYVGPLARGNSRFAWMTRKSEET
ITPWNFEEVVDKGASAQSFIERMTNFDKNLPNEKVLPKHSLLYEYFTVY
NELTKVKYVTEGMRKPAFLSGEQKKAIVDLLFKTNRKVTVKQLKEDYFK
KIECFDSVEISGVEDRFNASLGTYHDLLKIIKDKDFLDNEENEDILEDI
VLTLTLFEDREMIEERLKTYAHLFDDKVMKQLKRRRYTGWGRLSRKLIN
GIRDKQSGKTILDFLKSDGFANRNFMQLIHDDSLTFKEDIQKAQVSGQG
DSLHEHIANLAGSPAIKKGILQTVKVVDELVKVMGRHKPENIVIEMARE
NQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKNR
GKSDNVPSEEVVKKMKNYWRQLLNAKLITQRKFDNLTKAERGGLSELDK
AGFIKRQLVETRQITKHVAQILDSRMNTKYDENDKLIREVKVITLKSKL
VSDFRKDFQFYKVREINNYHHAHDAYLNAVVGTALIKKYPKLESEFVYG
DYKVYDVRKMIAKSEQEGADKRTADGSEFESPKKKRKV
(SEQ ID NO: 12).

13. The fusion protein of claim 1, wherein the polynucleotide programmable DNA binding domain comprises a Cas9 domain.

14. The fusion protein of claim 1, wherein the polynucleotide programmable DNA binding domain comprises the following amino acid sequence:

MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKERGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGEANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL

-continued

```
TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD (SEQ ID NO: 1).
```

15. The fusion protein of claim 1, wherein the Cas9 domain is a *Staphylococcus aureus* Cas9 (SaCas9), *Streptococcus thermophilus* 1 Cas9 (St1Cas9), a *Streptococcus pyogenes* Cas9 (SpCas9), or variants thereof.

16. The fusion protein of claim 1, wherein the polynucleotide programmable DNA binding domain is a nuclease inactive or nickase variant.

17. The fusion protein of claim 1, comprising a linker between the polynucleotide programmable DNA binding domain and the adenosine deaminase variant.

18. The fusion protein of claim 1, comprising one or more nuclear localization signals.

19. The fusion protein of claim 1, wherein the adenosine deaminase variant has at least 90% identity to the sequence.

20. The fusion protein of claim 1, wherein the adenosine deaminase variant has at least 95% identity to the sequence.

21. A polynucleotide encoding the fusion protein of claim 1.

22. An expression vector comprising the polynucleotide of claim 21.

23. The expression vector of claim 22, wherein the vector is a viral vector selected from the group consisting of adeno-associated virus (AAV), retroviral vector, adenoviral vector, lentiviral vector, Sendai virus vector, and herpesvirus vector.

24. A cell comprising the fusion protein of claim 1.

25. A base editor comprising the fusion polypeptide of claim 1 in a complex with one or more guide polynucleotides.

26. A method for base editing comprising contacting a polynucleotide sequence with the fusion protein of claim 1, wherein the adenosine deaminase variant deaminates a nucleobase in the polynucleotide, thereby editing the polynucleotide sequence.

27. A method of correcting a genetic defect in a subject, the method comprising administering to the subject
(i) a base editor comprising or consisting essentially of the fusion protein of claim 1, or
(ii) a polynucleotide encoding said base editor and one or more guide polynucleotides that direct the base editor to deaminate a target nucleobase in a target nucleotide sequence of the subject, thereby correcting the genetic defect.

28. The method of claim 27, comprising delivering the base editor, or polynucleotide encoding said base editor, and one or more guide polynucleotides to a cell of the subject.

29. The method of claim 27, wherein the subject is a mammal or a human.

30. The method of claim 27, wherein the deamination of the target nucleobase replaces the target nucleobase with a wild type nucleobase.

* * * * *